United States Patent 9,371,558 (COMPOSITIONS AND METHOD FOR MEASURING AND CALIBRATING AMPLIFICATION BIAS IN MULTIPLEXED PCR REACTIONS) - sequence listing, part 2

SEQ ID NO: 4761 - DNA, 495 bp, Artificial Sequence; identical to SEQ ID NO: 2481
  source: /note="Description of Artificial Sequence: Synthetic polynucleotide"

SEQ ID NO: 4762 - DNA, 495 bp, Artificial Sequence; identical to SEQ ID NO: 2482
  source: /note="Description of Artificial Sequence: Synthetic polynucleotide"

SEQ ID NO: 4763 - DNA, 495 bp, Artificial Sequence; identical to SEQ ID NO: 2483
  source: /note="Description of Artificial Sequence: Synthetic polynucleotide"

SEQ ID NO: 4764 - DNA, 495 bp, Artificial Sequence; identical to SEQ ID NO: 2484
  source: /note="Description of Artificial Sequence: Synthetic polynucleotide"

SEQ ID NO: 4765 - DNA, 495 bp, Artificial Sequence; identical to SEQ ID NO: 2485
  source: /note="Description of Artificial Sequence: Synthetic polynucleotide"

SEQ ID NO: 4766 - DNA, 495 bp, Artificial Sequence; identical to SEQ ID NO: 2486
  source: /note="Description of Artificial Sequence: Synthetic polynucleotide"

SEQ ID NO: 4767 - DNA, 495 bp, Artificial Sequence; identical to SEQ ID NO: 2487
  source: /note="Description of Artificial Sequence: Synthetic polynucleotide"

SEQ ID NO: 4768 - DNA, 495 bp, Artificial Sequence; identical to SEQ ID NO: 2488
  source: /note="Description of Artificial Sequence: Synthetic polynucleotide"

SEQ ID NO: 4769 - DNA, 495 bp, Artificial Sequence; identical to SEQ ID NO: 2489
  source: /note="Description of Artificial Sequence: Synthetic polynucleotide"

SEQ ID NO: 4770 - DNA, 495 bp, Artificial Sequence; identical to SEQ ID NO: 2490
  source: /note="Description of Artificial Sequence: Synthetic polynucleotide"

SEQ ID NO: 4771 - DNA, 495 bp, Artificial Sequence; identical to SEQ ID NO: 2491
  source: /note="Description of Artificial Sequence: Synthetic polynucleotide"

SEQ ID NO: 4772 - DNA, 495 bp, Artificial Sequence; identical to SEQ ID NO: 2492
  source: /note="Description of Artificial Sequence: Synthetic polynucleotide"

SEQ ID NO: 4773 - DNA, 495 bp, Artificial Sequence; identical to SEQ ID NO: 2493
  source: /note="Description of Artificial Sequence: Synthetic polynucleotide"

SEQ ID NO: 4774 - DNA, 495 bp, Artificial Sequence; identical to SEQ ID NO: 2494
  source: /note="Description of Artificial Sequence: Synthetic polynucleotide"

SEQ ID NO: 4775 - DNA, 495 bp, Artificial Sequence; identical to SEQ ID NO: 2495
  source: /note="Description of Artificial Sequence: Synthetic polynucleotide"

SEQ ID NO: 4776 - DNA, 495 bp, Artificial Sequence; identical to SEQ ID NO: 2496
  source: /note="Description of Artificial Sequence: Synthetic polynucleotide"

SEQ ID NO: 4777 - DNA, 495 bp, Artificial Sequence; identical to SEQ ID NO: 2497
  source: /note="Description of Artificial Sequence: Synthetic polynucleotide"

SEQ ID NO: 4778 - DNA, 495 bp, Artificial Sequence; identical to SEQ ID NO: 2498
  source: /note="Description of Artificial Sequence: Synthetic polynucleotide"

SEQ ID NO: 4779 - DNA, 495 bp, Artificial Sequence; identical to SEQ ID NO: 2499
  source: /note="Description of Artificial Sequence: Synthetic polynucleotide"

SEQ ID NO: 4780 - DNA, 495 bp, Artificial Sequence; identical to SEQ ID NO: 2500
  source: /note="Description of Artificial Sequence: Synthetic polynucleotide"

SEQ ID NO: 4781 - DNA, 495 bp, Artificial Sequence; identical to SEQ ID NO: 2501
  source: /note="Description of Artificial Sequence: Synthetic polynucleotide"

SEQ ID NO: 4782 - DNA, 495 bp, Artificial Sequence; identical to SEQ ID NO: 2502
  source: /note="Description of Artificial Sequence: Synthetic polynucleotide"

SEQ ID NO: 4783 - DNA, 495 bp, Artificial Sequence; identical to SEQ ID NO: 2503
  source: /note="Description of Artificial Sequence: Synthetic polynucleotide"

SEQ ID NO: 4784 - DNA, 495 bp, Artificial Sequence; identical to SEQ ID NO: 2504
  source: /note="Description of Artificial Sequence: Synthetic polynucleotide"

SEQ ID NO: 4785 - DNA, 495 bp, Artificial Sequence; identical to SEQ ID NO: 2505
  source: /note="Description of Artificial Sequence: Synthetic polynucleotide"

SEQ ID NO: 4786 - DNA, 495 bp, Artificial Sequence; identical to SEQ ID NO: 2506
  source: /note="Description of Artificial Sequence: Synthetic polynucleotide"

SEQ ID NO: 4787 - DNA, 495 bp, Artificial Sequence; identical to SEQ ID NO: 2507
  source: /note="Description of Artificial Sequence: Synthetic polynucleotide"

SEQ ID NO: 4788 - DNA, 495 bp, Artificial Sequence; identical to SEQ ID NO: 2508
  source: /note="Description of Artificial Sequence: Synthetic polynucleotide"

SEQ ID NO: 4789 - DNA, 495 bp, Artificial Sequence; identical to SEQ ID NO: 2509
  source: /note="Description of Artificial Sequence: Synthetic polynucleotide"

SEQ ID NO: 4790 - DNA, 495 bp, Artificial Sequence; identical to SEQ ID NO: 2510
  source: /note="Description of Artificial Sequence: Synthetic polynucleotide"

SEQ ID NO: 4791 - DNA, 495 bp, Artificial Sequence; identical to SEQ ID NO: 2511
  source: /note="Description of Artificial Sequence: Synthetic polynucleotide"

SEQ ID NO: 4792 - DNA, 495 bp, Artificial Sequence; identical to SEQ ID NO: 2512
  source: /note="Description of Artificial Sequence: Synthetic polynucleotide"

SEQ ID NO: 4793 - DNA, 495 bp, Artificial Sequence; identical to SEQ ID NO: 2513
  source: /note="Description of Artificial Sequence: Synthetic polynucleotide"

SEQ ID NO: 4794 - DNA, 495 bp, Artificial Sequence; identical to SEQ ID NO: 2514
  source: /note="Description of Artificial Sequence: Synthetic polynucleotide"

SEQ ID NO: 4795 - DNA, 495 bp, Artificial Sequence; identical to SEQ ID NO: 2515
  source: /note="Description of Artificial Sequence: Synthetic polynucleotide"

SEQ ID NO: 4796 - DNA, 495 bp, Artificial Sequence; identical to SEQ ID NO: 2516
  source: /note="Description of Artificial Sequence: Synthetic polynucleotide"

SEQ ID NO: 4797 - DNA, 495 bp, Artificial Sequence; identical to SEQ ID NO: 2517
  source: /note="Description of Artificial Sequence: Synthetic polynucleotide"

SEQ ID NO: 4798 - DNA, 495 bp, Artificial Sequence; identical to SEQ ID NO: 2518
  source: /note="Description of Artificial Sequence: Synthetic polynucleotide"

SEQ ID NO: 4799 - DNA, 495 bp, Artificial Sequence; identical to SEQ ID NO: 2519
  source: /note="Description of Artificial Sequence: Synthetic polynucleotide"

SEQ ID NO: 4800 - DNA, 495 bp, Artificial Sequence; identical to SEQ ID NO: 2520
  source: /note="Description of Artificial Sequence: Synthetic polynucleotide"

SEQ ID NO: 4801 - DNA, 495 bp, Artificial Sequence; identical to SEQ ID NO: 2521
  source: /note="Description of Artificial Sequence: Synthetic polynucleotide"

SEQ ID NO: 4802 - DNA, 495 bp, Artificial Sequence; identical to SEQ ID NO: 2522
  source: /note="Description of Artificial Sequence: Synthetic polynucleotide"

SEQ ID NO: 4803 - DNA, 495 bp, Artificial Sequence; identical to SEQ ID NO: 2523
  source: /note="Description of Artificial Sequence: Synthetic polynucleotide"

SEQ ID NO: 4804 - DNA, 495 bp, Artificial Sequence; identical to SEQ ID NO: 2524
  source: /note="Description of Artificial Sequence: Synthetic polynucleotide"

SEQ ID NO: 4805 - DNA, 495 bp, Artificial Sequence; identical to SEQ ID NO: 2525
  source: /note="Description of Artificial Sequence: Synthetic polynucleotide"

SEQ ID NO: 4806 - DNA, 495 bp, Artificial Sequence; identical to SEQ ID NO: 2526
  source: /note="Description of Artificial Sequence: Synthetic polynucleotide"

SEQ ID NO: 4807 - DNA, 495 bp, Artificial Sequence; identical to SEQ ID NO: 2527
  source: /note="Description of Artificial Sequence: Synthetic polynucleotide"

SEQ ID NO: 4808 - DNA, 495 bp, Artificial Sequence; identical to SEQ ID NO: 2528
  source: /note="Description of Artificial Sequence: Synthetic polynucleotide"

SEQ ID NO: 4809 - DNA, 495 bp, Artificial Sequence; identical to SEQ ID NO: 2529
  source: /note="Description of Artificial Sequence: Synthetic polynucleotide"

SEQ ID NO: 4810 - DNA, 495 bp, Artificial Sequence; identical to SEQ ID NO: 2530
  source: /note="Description of Artificial Sequence: Synthetic polynucleotide"

SEQ ID NO: 4811 - DNA, 495 bp, Artificial Sequence; identical to SEQ ID NO: 2531
  source: /note="Description of Artificial Sequence: Synthetic polynucleotide"

SEQ ID NO: 4812 - DNA, 495 bp, Artificial Sequence; identical to SEQ ID NO: 2532
  source: /note="Description of Artificial Sequence: Synthetic polynucleotide"

SEQ ID NO: 4813 - DNA, 495 bp, Artificial Sequence; identical to SEQ ID NO: 2533
  source: /note="Description of Artificial Sequence: Synthetic polynucleotide"

SEQ ID NO: 4814 - DNA, 495 bp, Artificial Sequence; identical to SEQ ID NO: 2534
  source: /note="Description of Artificial Sequence: Synthetic polynucleotide"

SEQ ID NO: 4815 - DNA, 495 bp, Artificial Sequence; identical to SEQ ID NO: 2535
  source: /note="Description of Artificial Sequence: Synthetic polynucleotide"

SEQ ID NO: 4816 - DNA, 495 bp, Artificial Sequence; identical to SEQ ID NO: 2536
  source: /note="Description of Artificial Sequence: Synthetic polynucleotide"

SEQ ID NO: 4817 - DNA, 495 bp, Artificial Sequence; identical to SEQ ID NO: 2537
  source: /note="Description of Artificial Sequence: Synthetic polynucleotide"

SEQ ID NO: 4818 - DNA, 495 bp, Artificial Sequence; identical to SEQ ID NO: 2538
  source: /note="Description of Artificial Sequence: Synthetic polynucleotide"

SEQ ID NO: 4819 - DNA, 495 bp, Artificial Sequence; identical to SEQ ID NO: 2539
  source: /note="Description of Artificial Sequence: Synthetic polynucleotide"

SEQ ID NO: 4820 - DNA, 495 bp, Artificial Sequence; identical to SEQ ID NO: 2540
  source: /note="Description of Artificial Sequence: Synthetic polynucleotide"

SEQ ID NO: 4821 - DNA, 495 bp, Artificial Sequence; identical to SEQ ID NO: 2541
  source: /note="Description of Artificial Sequence: Synthetic polynucleotide"

SEQ ID NO: 4822 - DNA, 495 bp, Artificial Sequence; identical to SEQ ID NO: 2542
  source: /note="Description of Artificial Sequence: Synthetic polynucleotide"

SEQ ID NO: 4823 - DNA, 495 bp, Artificial Sequence; identical to SEQ ID NO: 2543
  source: /note="Description of Artificial Sequence: Synthetic polynucleotide"

SEQ ID NO: 4824 - DNA, 495 bp, Artificial Sequence; identical to SEQ ID NO: 2544
  source: /note="Description of Artificial Sequence: Synthetic polynucleotide"

SEQ ID NO: 4825 - DNA, 495 bp, Artificial Sequence; identical to SEQ ID NO: 2545
  source: /note="Description of Artificial Sequence: Synthetic polynucleotide"

SEQ ID NO: 4826 - DNA, 495 bp, Artificial Sequence; identical to SEQ ID NO: 2546
  source: /note="Description of Artificial Sequence: Synthetic polynucleotide"

SEQ ID NO: 4827 - DNA, 448 bp, Artificial Sequence; identical to SEQ ID NO: 2547
  source: /note="Description of Artificial Sequence: Synthetic polynucleotide"

SEQ ID NO: 4828 - DNA, 495 bp, Artificial Sequence; identical to SEQ ID NO: 2548
  source: /note="Description of Artificial Sequence: Synthetic polynucleotide"

SEQ ID NO: 4829 - DNA, 495 bp, Artificial Sequence; identical to SEQ ID NO: 2549
  source: /note="Description of Artificial Sequence: Synthetic polynucleotide"

SEQ ID NO: 4830 - DNA, 495 bp, Artificial Sequence; identical to SEQ ID NO: 2550
  source: /note="Description of Artificial Sequence: Synthetic polynucleotide"

SEQ ID NO: 4831 - DNA, 495 bp, Artificial Sequence; identical to SEQ ID NO: 2551
  source: /note="Description of Artificial Sequence: Synthetic polynucleotide"

SEQ ID NO: 4832 - DNA, 495 bp, Artificial Sequence; identical to SEQ ID NO: 2552
  source: /note="Description of Artificial Sequence: Synthetic polynucleotide"

SEQ ID NO: 4833 - DNA, 495 bp, Artificial Sequence; identical to SEQ ID NO: 2553
  source: /note="Description of Artificial Sequence: Synthetic polynucleotide"

SEQ ID NO: 4834 - DNA, 495 bp, Artificial Sequence; identical to SEQ ID NO: 2554
  source: /note="Description of Artificial Sequence: Synthetic polynucleotide"

SEQ ID NO: 4835 - DNA, 495 bp, Artificial Sequence; identical to SEQ ID NO: 2555
  source: /note="Description of Artificial Sequence: Synthetic polynucleotide"

SEQ ID NO: 4836 - DNA, 495 bp, Artificial Sequence; identical to SEQ ID NO: 2556
  source: /note="Description of Artificial Sequence: Synthetic polynucleotide"

SEQ ID NO: 4837 - DNA, 495 bp, Artificial Sequence; identical to SEQ ID NO: 2557
  source: /note="Description of Artificial Sequence: Synthetic polynucleotide"

SEQ ID NO: 4838 - DNA, 495 bp, Artificial Sequence; identical to SEQ ID NO: 2558
  source: /note="Description of Artificial Sequence: Synthetic polynucleotide"

SEQ ID NO: 4839 - DNA, 495 bp, Artificial Sequence; identical to SEQ ID NO: 2559
  source: /note="Description of Artificial Sequence: Synthetic polynucleotide"

SEQ ID NO: 4840 - DNA, 495 bp, Artificial Sequence; identical to SEQ ID NO: 2560
  source: /note="Description of Artificial Sequence: Synthetic polynucleotide"

SEQ ID NO: 4841 - DNA, 495 bp, Artificial Sequence; identical to SEQ ID NO: 2561
  source: /note="Description of Artificial Sequence: Synthetic polynucleotide"

SEQ ID NO: 4842 - DNA, 495 bp, Artificial Sequence; identical to SEQ ID NO: 2562
  source: /note="Description of Artificial Sequence: Synthetic polynucleotide"

SEQ ID NO: 4843 - DNA, 495 bp, Artificial Sequence; identical to SEQ ID NO: 2563
  source: /note="Description of Artificial Sequence: Synthetic polynucleotide"

SEQ ID NO: 4844 - DNA, 495 bp, Artificial Sequence; identical to SEQ ID NO: 2564
  source: /note="Description of Artificial Sequence: Synthetic polynucleotide"

SEQ ID NO: 4845 - DNA, 495 bp, Artificial Sequence; identical to SEQ ID NO: 2565
  source: /note="Description of Artificial Sequence: Synthetic polynucleotide"

SEQ ID NO: 4846 - DNA, 495 bp, Artificial Sequence; identical to SEQ ID NO: 2566
  source: /note="Description of Artificial Sequence: Synthetic polynucleotide"

SEQ ID NO: 4847 - DNA, 495 bp, Artificial Sequence; identical to SEQ ID NO: 2567
  source: /note="Description of Artificial Sequence: Synthetic polynucleotide"

SEQ ID NO: 4848 - DNA, 495 bp, Artificial Sequence; identical to SEQ ID NO: 2568
  source: /note="Description of Artificial Sequence: Synthetic polynucleotide"

SEQ ID NO: 4849 - DNA, 495 bp, Artificial Sequence; identical to SEQ ID NO: 2569
  source: /note="Description of Artificial Sequence: Synthetic polynucleotide"

SEQ ID NO: 4850 - DNA, 495 bp, Artificial Sequence; identical to SEQ ID NO: 2570
  source: /note="Description of Artificial Sequence: Synthetic polynucleotide"

SEQ ID NO: 4851 - DNA, 495 bp, Artificial Sequence; identical to SEQ ID NO: 2571
  source: /note="Description of Artificial Sequence: Synthetic polynucleotide"

SEQ ID NO: 4852 - DNA, 495 bp, Artificial Sequence; identical to SEQ ID NO: 2572
  source: /note="Description of Artificial Sequence: Synthetic polynucleotide"

SEQ ID NO: 4853 - DNA, 495 bp, Artificial Sequence; identical to SEQ ID NO: 2573
  source: /note="Description of Artificial Sequence: Synthetic polynucleotide"

SEQ ID NO: 4854 - DNA, 495 bp, Artificial Sequence; identical to SEQ ID NO: 2574
  source: /note="Description of Artificial Sequence: Synthetic polynucleotide"

SEQ ID NO: 4855 - DNA, 495 bp, Artificial Sequence; identical to SEQ ID NO: 2575
  source: /note="Description of Artificial Sequence: Synthetic polynucleotide"

SEQ ID NO: 4856 - DNA, 495 bp, Artificial Sequence; identical to SEQ ID NO: 2576
  source: /note="Description of Artificial Sequence: Synthetic polynucleotide"

SEQ ID NO: 4857 - DNA, 495 bp, Artificial Sequence; identical to SEQ ID NO: 2577
  source: /note="Description of Artificial Sequence: Synthetic polynucleotide"

SEQ ID NO: 4858 - DNA, 495 bp, Artificial Sequence; identical to SEQ ID NO: 2578
  source: /note="Description of Artificial Sequence: Synthetic polynucleotide"

SEQ ID NO: 4859 - DNA, 495 bp, Artificial Sequence; identical to SEQ ID NO: 2579
  source: /note="Description of Artificial Sequence: Synthetic polynucleotide"

SEQ ID NO: 4860 - DNA, 495 bp, Artificial Sequence; identical to SEQ ID NO: 2580
  source: /note="Description of Artificial Sequence: Synthetic polynucleotide"

SEQ ID NO: 4861 - DNA, 495 bp, Artificial Sequence; identical to SEQ ID NO: 2581
  source: /note="Description of Artificial Sequence: Synthetic polynucleotide"

SEQ ID NO: 4862 - DNA, 495 bp, Artificial Sequence; identical to SEQ ID NO: 2582
  source: /note="Description of Artificial Sequence: Synthetic polynucleotide"

SEQ ID NO: 4863 - DNA, 495 bp, Artificial Sequence; identical to SEQ ID NO: 2583
  source: /note="Description of Artificial Sequence: Synthetic polynucleotide"

SEQ ID NO: 4864 - DNA, 495 bp, Artificial Sequence; identical to SEQ ID NO: 2584
  source: /note="Description of Artificial Sequence: Synthetic polynucleotide"

SEQ ID NO: 4865 - DNA, 495 bp, Artificial Sequence; identical to SEQ ID NO: 2585
  source: /note="Description of Artificial Sequence: Synthetic polynucleotide"

SEQ ID NO: 4866 - DNA, 495 bp, Artificial Sequence; identical to SEQ ID NO: 2586
  source: /note="Description of Artificial Sequence: Synthetic polynucleotide"

SEQ ID NO: 4867 - DNA, 495 bp, Artificial Sequence; identical to SEQ ID NO: 2587
  source: /note="Description of Artificial Sequence: Synthetic polynucleotide"

SEQ ID NO: 4868 - DNA, 495 bp, Artificial Sequence; identical to SEQ ID NO: 2588
  source: /note="Description of Artificial Sequence: Synthetic polynucleotide"

SEQ ID NO: 4869 - DNA, 495 bp, Artificial Sequence; identical to SEQ ID NO: 2589
  source: /note="Description of Artificial Sequence: Synthetic polynucleotide"

SEQ ID NO: 4870 - DNA, 495 bp, Artificial Sequence; identical to SEQ ID NO: 2590
  source: /note="Description of Artificial Sequence: Synthetic polynucleotide"

SEQ ID NO: 4871 - DNA, 495 bp, Artificial Sequence; identical to SEQ ID NO: 2591
  source: /note="Description of Artificial Sequence: Synthetic polynucleotide"

SEQ ID NO: 4872 - DNA, 495 bp, Artificial Sequence; identical to SEQ ID NO: 2592
  source: /note="Description of Artificial Sequence: Synthetic polynucleotide"

SEQ ID NO: 4873 - DNA, 495 bp, Artificial Sequence; identical to SEQ ID NO: 2593
  source: /note="Description of Artificial Sequence: Synthetic polynucleotide"

SEQ ID NO: 4874 - DNA, 495 bp, Artificial Sequence; identical to SEQ ID NO: 2594
  source: /note="Description of Artificial Sequence: Synthetic polynucleotide"

SEQ ID NO: 4875 - DNA, 495 bp, Artificial Sequence; identical to SEQ ID NO: 2595
  source: /note="Description of Artificial Sequence: Synthetic polynucleotide"

SEQ ID NO: 4876 - DNA, 495 bp, Artificial Sequence; identical to SEQ ID NO: 2596
  source: /note="Description of Artificial Sequence: Synthetic polynucleotide"

SEQ ID NO: 4877 - DNA, 495 bp, Artificial Sequence; identical to SEQ ID NO: 2597
  source: /note="Description of Artificial Sequence: Synthetic polynucleotide"

SEQ ID NO: 4878 - DNA, 495 bp, Artificial Sequence; identical to SEQ ID NO: 2598
  source: /note="Description of Artificial Sequence: Synthetic polynucleotide"

SEQ ID NO: 4879 - DNA, 495 bp, Artificial Sequence; identical to SEQ ID NO: 2599
  source: /note="Description of Artificial Sequence: Synthetic polynucleotide"

SEQ ID NO: 4880 - DNA, 495 bp, Artificial Sequence; identical to SEQ ID NO: 2600
  source: /note="Description of Artificial Sequence: Synthetic polynucleotide"

SEQ ID NO: 4881 - DNA, 495 bp, Artificial Sequence; identical to SEQ ID NO: 2601
  source: /note="Description of Artificial Sequence: Synthetic polynucleotide"

SEQ ID NO: 4882 - DNA, 495 bp, Artificial Sequence; identical to SEQ ID NO: 2602
  source: /note="Description of Artificial Sequence: Synthetic polynucleotide"

SEQ ID NO: 4883 - DNA, 495 bp, Artificial Sequence; identical to SEQ ID NO: 2603
  source: /note="Description of Artificial Sequence: Synthetic polynucleotide"

SEQ ID NO: 4884 - DNA, 495 bp, Artificial Sequence; identical to SEQ ID NO: 2604
  source: /note="Description of Artificial Sequence: Synthetic polynucleotide"

SEQ ID NO: 4885 - DNA, 495 bp, Artificial Sequence; identical to SEQ ID NO: 2605
  source: /note="Description of Artificial Sequence: Synthetic polynucleotide"

SEQ ID NO: 4886 - DNA, 495 bp, Artificial Sequence; identical to SEQ ID NO: 2606
  source: /note="Description of Artificial Sequence: Synthetic polynucleotide"

SEQ ID NO: 4887 - DNA, 495 bp, Artificial Sequence; identical to SEQ ID NO: 2607
  source: /note="Description of Artificial Sequence: Synthetic polynucleotide"

SEQ ID NO: 4888 - DNA, 495 bp, Artificial Sequence; identical to SEQ ID NO: 2608
  source: /note="Description of Artificial Sequence: Synthetic polynucleotide"

SEQ ID NO: 4889 - DNA, 495 bp, Artificial Sequence; identical to SEQ ID NO: 2609
  source: /note="Description of Artificial Sequence: Synthetic polynucleotide"

SEQ ID NO: 4890 - DNA, 495 bp, Artificial Sequence; identical to SEQ ID NO: 2610
  source: /note="Description of Artificial Sequence: Synthetic polynucleotide"

SEQ ID NO: 4891 - DNA, 495 bp, Artificial Sequence; identical to SEQ ID NO: 2611
  source: /note="Description of Artificial Sequence: Synthetic polynucleotide"

SEQ ID NO: 4892 - DNA, 495 bp, Artificial Sequence; identical to SEQ ID NO: 2612
  source: /note="Description of Artificial Sequence: Synthetic polynucleotide"

SEQ ID NO: 4893 - DNA, 495 bp, Artificial Sequence; identical to SEQ ID NO: 2613
  source: /note="Description of Artificial Sequence: Synthetic polynucleotide"

SEQ ID NO: 4894 - DNA, 495 bp, Artificial Sequence; identical to SEQ ID NO: 2614
  source: /note="Description of Artificial Sequence: Synthetic polynucleotide"

SEQ ID NO: 4895 - DNA, 495 bp, Artificial Sequence; identical to SEQ ID NO: 2615
  source: /note="Description of Artificial Sequence: Synthetic polynucleotide"

SEQ ID NO: 4896 - DNA, 495 bp, Artificial Sequence; identical to SEQ ID NO: 2616
  source: /note="Description of Artificial Sequence: Synthetic polynucleotide"

SEQ ID NO: 4897 - DNA, 495 bp, Artificial Sequence; identical to SEQ ID NO: 2617
  source: /note="Description of Artificial Sequence: Synthetic polynucleotide"

SEQ ID NO: 4898 - DNA, 495 bp, Artificial Sequence; identical to SEQ ID NO: 2618
  source: /note="Description of Artificial Sequence: Synthetic polynucleotide"

SEQ ID NO: 4899 - DNA, 495 bp, Artificial Sequence; identical to SEQ ID NO: 2619
  source: /note="Description of Artificial Sequence: Synthetic polynucleotide"

SEQ ID NO: 4900 - DNA, 495 bp, Artificial Sequence; identical to SEQ ID NO: 2620
  source: /note="Description of Artificial Sequence: Synthetic polynucleotide"

SEQ ID NO: 4901 - DNA, 495 bp, Artificial Sequence; identical to SEQ ID NO: 2621
  source: /note="Description of Artificial Sequence: Synthetic polynucleotide"

SEQ ID NO: 4902 - DNA, 495 bp, Artificial Sequence; identical to SEQ ID NO: 2622
  source: /note="Description of Artificial Sequence: Synthetic polynucleotide"

SEQ ID NO: 4903 - DNA, 495 bp, Artificial Sequence; identical to SEQ ID NO: 2623
  source: /note="Description of Artificial Sequence: Synthetic polynucleotide"

SEQ ID NO: 4904 - DNA, 495 bp, Artificial Sequence; identical to SEQ ID NO: 2624
  source: /note="Description of Artificial Sequence: Synthetic polynucleotide"

SEQ ID NO: 4905 - DNA, 495 bp, Artificial Sequence; identical to SEQ ID NO: 2625
  source: /note="Description of Artificial Sequence: Synthetic polynucleotide"

SEQ ID NO: 4906 - DNA, 495 bp, Artificial Sequence; identical to SEQ ID NO: 2626
  source: /note="Description of Artificial Sequence: Synthetic polynucleotide"

SEQ ID NO: 4907 - DNA, 495 bp, Artificial Sequence; identical to SEQ ID NO: 2627
  source: /note="Description of Artificial Sequence: Synthetic polynucleotide"

SEQ ID NO: 4908 - DNA, 495 bp, Artificial Sequence; identical to SEQ ID NO: 2628
  source: /note="Description of Artificial Sequence: Synthetic polynucleotide"

SEQ ID NO: 4909 - DNA, 495 bp, Artificial Sequence; identical to SEQ ID NO: 2629
  source: /note="Description of Artificial Sequence: Synthetic polynucleotide"

SEQ ID NO: 4910 - DNA, 495 bp, Artificial Sequence; identical to SEQ ID NO: 2630
  source: /note="Description of Artificial Sequence: Synthetic polynucleotide"

SEQ ID NO: 4911 - DNA, 495 bp, Artificial Sequence; identical to SEQ ID NO: 2631
  source: /note="Description of Artificial Sequence: Synthetic polynucleotide"

SEQ ID NO: 4912 - DNA, 495 bp, Artificial Sequence; identical to SEQ ID NO: 2632
  source: /note="Description of Artificial Sequence: Synthetic polynucleotide"

SEQ ID NO: 4913 - DNA, 495 bp, Artificial Sequence; identical to SEQ ID NO: 2633
  source: /note="Description of Artificial Sequence: Synthetic polynucleotide"

SEQ ID NO: 4914 - DNA, 495 bp, Artificial Sequence; identical to SEQ ID NO: 2634
  source: /note="Description of Artificial Sequence: Synthetic polynucleotide"

SEQ ID NO: 4915 - DNA, 495 bp, Artificial Sequence; identical to SEQ ID NO: 2635
  source: /note="Description of Artificial Sequence: Synthetic polynucleotide"

SEQ ID NO: 4916 - DNA, 495 bp, Artificial Sequence; identical to SEQ ID NO: 2636
  source: /note="Description of Artificial Sequence: Synthetic polynucleotide"

SEQ ID NO: 4917 - DNA, 495 bp, Artificial Sequence; identical to SEQ ID NO: 2637
  source: /note="Description of Artificial Sequence: Synthetic polynucleotide"

SEQ ID NO: 4918 - DNA, 495 bp, Artificial Sequence; identical to SEQ ID NO: 2638
  source: /note="Description of Artificial Sequence: Synthetic polynucleotide"

SEQ ID NO: 4919 - DNA, 495 bp, Artificial Sequence; identical to SEQ ID NO: 2639
  source: /note="Description of Artificial Sequence: Synthetic polynucleotide"

SEQ ID NO: 4920 - DNA, 495 bp, Artificial Sequence; identical to SEQ ID NO: 2640
  source: /note="Description of Artificial Sequence: Synthetic polynucleotide"

SEQ ID NO: 4921 - DNA, 495 bp, Artificial Sequence; identical to SEQ ID NO: 2641
  source: /note="Description of Artificial Sequence: Synthetic polynucleotide"

SEQ ID NO: 4922 - DNA, 495 bp, Artificial Sequence; identical to SEQ ID NO: 2642
  source: /note="Description of Artificial Sequence: Synthetic polynucleotide"

SEQ ID NO: 4923 - DNA, 495 bp, Artificial Sequence; identical to SEQ ID NO: 2643
  source: /note="Description of Artificial Sequence: Synthetic polynucleotide"

SEQ ID NO: 4924 - DNA, 495 bp, Artificial Sequence; identical to SEQ ID NO: 2644
  source: /note="Description of Artificial Sequence: Synthetic polynucleotide"

SEQ ID NO: 4925 - DNA, 495 bp, Artificial Sequence; identical to SEQ ID NO: 2645
  source: /note="Description of Artificial Sequence: Synthetic polynucleotide"

SEQ ID NO: 4926 - DNA, 495 bp, Artificial Sequence; identical to SEQ ID NO: 2646
  source: /note="Description of Artificial Sequence: Synthetic polynucleotide"

SEQ ID NO: 4927 - DNA, 495 bp, Artificial Sequence; identical to SEQ ID NO: 2647
  source: /note="Description of Artificial Sequence: Synthetic polynucleotide"

SEQ ID NO: 4928 - DNA, 495 bp, Artificial Sequence; identical to SEQ ID NO: 2648
  source: /note="Description of Artificial Sequence: Synthetic polynucleotide"

SEQ ID NO: 4929 - DNA, 495 bp, Artificial Sequence; identical to SEQ ID NO: 2649
  source: /note="Description of Artificial Sequence: Synthetic polynucleotide"

SEQ ID NO: 4930 - DNA, 495 bp, Artificial Sequence; identical to SEQ ID NO: 2650
  source: /note="Description of Artificial Sequence: Synthetic polynucleotide"

SEQ ID NO: 4931 - DNA, 495 bp, Artificial Sequence; identical to SEQ ID NO: 2651
  source: /note="Description of Artificial Sequence: Synthetic polynucleotide"

SEQ ID NO: 4932 - DNA, 495 bp, Artificial Sequence; identical to SEQ ID NO: 2652
  source: /note="Description of Artificial Sequence: Synthetic polynucleotide"

SEQ ID NO: 4933 - DNA, 495 bp, Artificial Sequence; identical to SEQ ID NO: 2653
  source: /note="Description of Artificial Sequence: Synthetic polynucleotide"

SEQ ID NO: 4934 - DNA, 495 bp, Artificial Sequence; identical to SEQ ID NO: 2654
  source: /note="Description of Artificial Sequence: Synthetic polynucleotide"

SEQ ID NO: 4935 - DNA, 495 bp, Artificial Sequence; identical to SEQ ID NO: 2655
  source: /note="Description of Artificial Sequence: Synthetic polynucleotide"

SEQ ID NO: 4936 - DNA, 495 bp, Artificial Sequence; identical to SEQ ID NO: 2656
  source: /note="Description of Artificial Sequence: Synthetic polynucleotide"

SEQ ID NO: 4937 - DNA, 495 bp, Artificial Sequence; identical to SEQ ID NO: 2657
  source: /note="Description of Artificial Sequence: Synthetic polynucleotide"

SEQ ID NO: 4938 - DNA, 495 bp, Artificial Sequence; identical to SEQ ID NO: 2658
  source: /note="Description of Artificial Sequence: Synthetic polynucleotide"

SEQ ID NO: 4939 - DNA, 495 bp, Artificial Sequence; identical to SEQ ID NO: 2659
  source: /note="Description of Artificial Sequence: Synthetic polynucleotide"

SEQ ID NO: 4940 - DNA, 495 bp, Artificial Sequence; identical to SEQ ID NO: 2660
  source: /note="Description of Artificial Sequence: Synthetic polynucleotide"

SEQ ID NO: 4941 - DNA, 495 bp, Artificial Sequence; identical to SEQ ID NO: 2661
  source: /note="Description of Artificial Sequence: Synthetic polynucleotide"

SEQ ID NO: 4942 - DNA, 495 bp, Artificial Sequence; identical to SEQ ID NO: 2662
  source: /note="Description of Artificial Sequence: Synthetic polynucleotide"

SEQ ID NO: 4943 - DNA, 495 bp, Artificial Sequence; identical to SEQ ID NO: 2663
  source: /note="Description of Artificial Sequence: Synthetic polynucleotide"

SEQ ID NO: 4944 - DNA, 495 bp, Artificial Sequence; identical to SEQ ID NO: 2664
  source: /note="Description of Artificial Sequence: Synthetic polynucleotide"

SEQ ID NO: 4945 - DNA, 495 bp, Artificial Sequence; identical to SEQ ID NO: 2665
  source: /note="Description of Artificial Sequence: Synthetic polynucleotide"

SEQ ID NO: 4946 - DNA, 495 bp, Artificial Sequence; identical to SEQ ID NO: 2666
  source: /note="Description of Artificial Sequence: Synthetic polynucleotide"

SEQ ID NO: 4947 - DNA, 495 bp, Artificial Sequence; identical to SEQ ID NO: 2667
  source: /note="Description of Artificial Sequence: Synthetic polynucleotide"

SEQ ID NO: 4948 - DNA, 495 bp, Artificial Sequence; identical to SEQ ID NO: 2668
  source: /note="Description of Artificial Sequence: Synthetic polynucleotide"

SEQ ID NO: 4949 - DNA, 495 bp, Artificial Sequence; identical to SEQ ID NO: 2669
  source: /note="Description of Artificial Sequence: Synthetic polynucleotide"

SEQ ID NO: 4950 - DNA, 495 bp, Artificial Sequence; identical to SEQ ID NO: 2670
  source: /note="Description of Artificial Sequence: Synthetic polynucleotide"

SEQ ID NO: 4951 - DNA, 448 bp, Artificial Sequence; identical to SEQ ID NO: 2671
  source: /note="Description of Artificial Sequence: Synthetic polynucleotide"

SEQ ID NO: 4952 - DNA, 495 bp, Artificial Sequence; identical to SEQ ID NO: 2672
  source: /note="Description of Artificial Sequence: Synthetic polynucleotide"

SEQ ID NO: 4953 - DNA, 495 bp, Artificial Sequence; identical to SEQ ID NO: 2673
  source: /note="Description of Artificial Sequence: Synthetic polynucleotide"

SEQ ID NO: 4954 - DNA, 495 bp, Artificial Sequence; identical to SEQ ID NO: 2674
  source: /note="Description of Artificial Sequence: Synthetic polynucleotide"

SEQ ID NO: 4955 - DNA, 495 bp, Artificial Sequence; identical to SEQ ID NO: 2675
  source: /note="Description of Artificial Sequence: Synthetic polynucleotide"

SEQ ID NO: 4956 - DNA, 495 bp, Artificial Sequence; identical to SEQ ID NO: 2676
  source: /note="Description of Artificial Sequence: Synthetic polynucleotide"

SEQ ID NO: 4957 - DNA, 495 bp, Artificial Sequence; identical to SEQ ID NO: 2677
  source: /note="Description of Artificial Sequence: Synthetic polynucleotide"

SEQ ID NO: 4958 - DNA, 495 bp, Artificial Sequence; identical to SEQ ID NO: 2678
  source: /note="Description of Artificial Sequence: Synthetic polynucleotide"

SEQ ID NO: 4959 - DNA, 495 bp, Artificial Sequence; identical to SEQ ID NO: 2679
  source: /note="Description of Artificial Sequence: Synthetic polynucleotide"

SEQ ID NO: 4960 - DNA, 495 bp, Artificial Sequence; identical to SEQ ID NO: 2680
  source: /note="Description of Artificial Sequence: Synthetic polynucleotide"

SEQ ID NO: 4961 - DNA, 495 bp, Artificial Sequence; identical to SEQ ID NO: 2681
  source: /note="Description of Artificial Sequence: Synthetic polynucleotide"

SEQ ID NO: 4962 - DNA, 495 bp, Artificial Sequence; identical to SEQ ID NO: 2682
  source: /note="Description of Artificial Sequence: Synthetic polynucleotide"

SEQ ID NO: 4963 - DNA, 495 bp, Artificial Sequence; identical to SEQ ID NO: 2683
  source: /note="Description of Artificial Sequence: Synthetic polynucleotide"

SEQ ID NO: 4964 - DNA, 495 bp, Artificial Sequence; identical to SEQ ID NO: 2684
  source: /note="Description of Artificial Sequence: Synthetic polynucleotide"

SEQ ID NO: 4965 - DNA, 495 bp, Artificial Sequence; identical to SEQ ID NO: 2685
  source: /note="Description of Artificial Sequence: Synthetic polynucleotide"

SEQ ID NO: 4966 - DNA, 495 bp, Artificial Sequence; identical to SEQ ID NO: 2686
  source: /note="Description of Artificial Sequence: Synthetic polynucleotide"

SEQ ID NO: 4967 - DNA, 495 bp, Artificial Sequence; identical to SEQ ID NO: 2687
  source: /note="Description of Artificial Sequence: Synthetic polynucleotide"

SEQ ID NO: 4968 - DNA, 495 bp, Artificial Sequence; identical to SEQ ID NO: 2688
  source: /note="Description of Artificial Sequence: Synthetic polynucleotide"

SEQ ID NO: 4969 - DNA, 495 bp, Artificial Sequence; identical to SEQ ID NO: 2689
  source: /note="Description of Artificial Sequence: Synthetic polynucleotide"

SEQ ID NO: 4970 - DNA, 495 bp, Artificial Sequence; identical to SEQ ID NO: 2690
  source: /note="Description of Artificial Sequence: Synthetic polynucleotide"

SEQ ID NO: 4971 - DNA, 495 bp, Artificial Sequence; identical to SEQ ID NO: 2691
  source: /note="Description of Artificial Sequence: Synthetic polynucleotide"

SEQ ID NO: 4972 - DNA, 495 bp, Artificial Sequence; identical to SEQ ID NO: 2692
  source: /note="Description of Artificial Sequence: Synthetic polynucleotide"

SEQ ID NO: 4973 - DNA, 495 bp, Artificial Sequence; identical to SEQ ID NO: 2693
  source: /note="Description of Artificial Sequence: Synthetic polynucleotide"

SEQ ID NO: 4974 - DNA, 495 bp, Artificial Sequence; identical to SEQ ID NO: 2694
  source: /note="Description of Artificial Sequence: Synthetic polynucleotide"

SEQ ID NO: 4975 - DNA, 495 bp, Artificial Sequence; identical to SEQ ID NO: 2695
  source: /note="Description of Artificial Sequence: Synthetic polynucleotide"

SEQ ID NO: 4976 - DNA, 495 bp, Artificial Sequence; identical to SEQ ID NO: 2696
  source: /note="Description of Artificial Sequence: Synthetic polynucleotide"

SEQ ID NO: 4977 - DNA, 495 bp, Artificial Sequence; identical to SEQ ID NO: 2697
  source: /note="Description of Artificial Sequence: Synthetic polynucleotide"

SEQ ID NO: 4978 - DNA, 495 bp, Artificial Sequence; identical to SEQ ID NO: 2698
  source: /note="Description of Artificial Sequence: Synthetic polynucleotide"

SEQ ID NO: 4979 - DNA, 495 bp, Artificial Sequence; identical to SEQ ID NO: 2699
  source: /note="Description of Artificial Sequence: Synthetic polynucleotide"

SEQ ID NO: 4980 - DNA, 495 bp, Artificial Sequence; identical to SEQ ID NO: 2700
  source: /note="Description of Artificial Sequence: Synthetic polynucleotide"

SEQ ID NO: 4981 - DNA, 495 bp, Artificial Sequence; identical to SEQ ID NO: 2701
  source: /note="Description of Artificial Sequence: Synthetic polynucleotide"

SEQ ID NO: 4982 - DNA, 495 bp, Artificial Sequence; identical to SEQ ID NO: 2702
  source: /note="Description of Artificial Sequence: Synthetic polynucleotide"

SEQ ID NO: 4983 - DNA, 495 bp, Artificial Sequence; identical to SEQ ID NO: 2703
  source: /note="Description of Artificial Sequence: Synthetic polynucleotide"

SEQ ID NO: 4984 - DNA, 495 bp, Artificial Sequence; identical to SEQ ID NO: 2704
  source: /note="Description of Artificial Sequence: Synthetic polynucleotide"

SEQ ID NO: 4985 - DNA, 495 bp, Artificial Sequence; identical to SEQ ID NO: 2705
  source: /note="Description of Artificial Sequence: Synthetic polynucleotide"

SEQ ID NO: 4986 - DNA, 495 bp, Artificial Sequence; identical to SEQ ID NO: 2706
  source: /note="Description of Artificial Sequence: Synthetic polynucleotide"

SEQ ID NO: 4987 - DNA, 495 bp, Artificial Sequence; identical to SEQ ID NO: 2707
  source: /note="Description of Artificial Sequence: Synthetic polynucleotide"

SEQ ID NO: 4988 - DNA, 495 bp, Artificial Sequence; identical to SEQ ID NO: 2708
  source: /note="Description of Artificial Sequence: Synthetic polynucleotide"

SEQ ID NO: 4989 - DNA, 495 bp, Artificial Sequence; identical to SEQ ID NO: 2709
  source: /note="Description of Artificial Sequence: Synthetic polynucleotide"

SEQ ID NO: 4990 - DNA, 495 bp, Artificial Sequence; identical to SEQ ID NO: 2710
  source: /note="Description of Artificial Sequence: Synthetic polynucleotide"

SEQ ID NO: 4991 - DNA, 495 bp, Artificial Sequence; identical to SEQ ID NO: 2711
  source: /note="Description of Artificial Sequence: Synthetic polynucleotide"

SEQ ID NO: 4992 - DNA, 495 bp, Artificial Sequence; identical to SEQ ID NO: 2712
  source: /note="Description of Artificial Sequence: Synthetic polynucleotide"

SEQ ID NO: 4993 - DNA, 495 bp, Artificial Sequence; identical to SEQ ID NO: 2713
  source: /note="Description of Artificial Sequence: Synthetic polynucleotide"

SEQ ID NO: 4994 - DNA, 495 bp, Artificial Sequence; identical to SEQ ID NO: 2714
  source: /note="Description of Artificial Sequence: Synthetic polynucleotide"

SEQ ID NO: 4995 - DNA, 495 bp, Artificial Sequence; identical to SEQ ID NO: 2715
  source: /note="Description of Artificial Sequence: Synthetic polynucleotide"

SEQ ID NO: 4996 - DNA, 495 bp, Artificial Sequence; identical to SEQ ID NO: 2716
  source: /note="Description of Artificial Sequence: Synthetic polynucleotide"

SEQ ID NO: 4997 - DNA, 495 bp, Artificial Sequence; identical to SEQ ID NO: 2717
  source: /note="Description of Artificial Sequence: Synthetic polynucleotide"

SEQ ID NO: 4998 - DNA, 495 bp, Artificial Sequence; identical to SEQ ID NO: 2718
  source: /note="Description of Artificial Sequence: Synthetic polynucleotide"

SEQ ID NO: 4999 - DNA, 495 bp, Artificial Sequence; identical to SEQ ID NO: 2719
  source: /note="Description of Artificial Sequence: Synthetic polynucleotide"

SEQ ID NO: 5000 - DNA, 495 bp, Artificial Sequence; identical to SEQ ID NO: 2720
  source: /note="Description of Artificial Sequence: Synthetic polynucleotide"

SEQ ID NO: 5001 - DNA, 495 bp, Artificial Sequence; identical to SEQ ID NO: 2721
  source: /note="Description of Artificial Sequence: Synthetic polynucleotide"

SEQ ID NO: 5002 - DNA, 495 bp, Artificial Sequence; identical to SEQ ID NO: 2722
  source: /note="Description of Artificial Sequence: Synthetic polynucleotide"

SEQ ID NO: 5003 - DNA, 495 bp, Artificial Sequence; identical to SEQ ID NO: 2723
  source: /note="Description of Artificial Sequence: Synthetic polynucleotide"

SEQ ID NO: 5004 - DNA, 495 bp, Artificial Sequence; identical to SEQ ID NO: 2724
  source: /note="Description of Artificial Sequence: Synthetic polynucleotide"

SEQ ID NO: 5005 - DNA, 495 bp, Artificial Sequence; identical to SEQ ID NO: 2725
  source: /note="Description of Artificial Sequence: Synthetic polynucleotide"

SEQ ID NO: 5006 - DNA, 495 bp, Artificial Sequence; identical to SEQ ID NO: 2726
  source: /note="Description of Artificial Sequence: Synthetic polynucleotide"

SEQ ID NO: 5007 - DNA, 495 bp, Artificial Sequence; identical to SEQ ID NO: 2727
  source: /note="Description of Artificial Sequence: Synthetic polynucleotide"

SEQ ID NO: 5008 - DNA, 495 bp, Artificial Sequence; identical to SEQ ID NO: 2728
  source: /note="Description of Artificial Sequence: Synthetic polynucleotide"

SEQ ID NO: 5009 - DNA, 495 bp, Artificial Sequence; identical to SEQ ID NO: 2729
  source: /note="Description of Artificial Sequence: Synthetic polynucleotide"

SEQ ID NO: 5010 - DNA, 495 bp, Artificial Sequence; identical to SEQ ID NO: 2730
  source: /note="Description of Artificial Sequence: Synthetic polynucleotide"

SEQ ID NO: 5011 - DNA, 495 bp, Artificial Sequence; identical to SEQ ID NO: 2731
  source: /note="Description of Artificial Sequence: Synthetic polynucleotide"

SEQ ID NO: 5012 - DNA, 495 bp, Artificial Sequence; identical to SEQ ID NO: 2732
  source: /note="Description of Artificial Sequence: Synthetic polynucleotide"

SEQ ID NO: 5013 - DNA, 495 bp, Artificial Sequence; identical to SEQ ID NO: 2733
  source: /note="Description of Artificial Sequence: Synthetic polynucleotide"

SEQ ID NO: 5014 - DNA, 495 bp, Artificial Sequence; identical to SEQ ID NO: 2734
  source: /note="Description of Artificial Sequence: Synthetic polynucleotide"

SEQ ID NO: 5015 - DNA, 495 bp, Artificial Sequence; identical to SEQ ID NO: 2735
  source: /note="Description of Artificial Sequence: Synthetic polynucleotide"

SEQ ID NO: 5016 - DNA, 495 bp, Artificial Sequence; identical to SEQ ID NO: 2736
  source: /note="Description of Artificial Sequence: Synthetic polynucleotide"

SEQ ID NO: 5017 - DNA, 495 bp, Artificial Sequence; identical to SEQ ID NO: 2737
  source: /note="Description of Artificial Sequence: Synthetic polynucleotide"

SEQ ID NO: 5018 - DNA, 495 bp, Artificial Sequence; identical to SEQ ID NO: 2738
  source: /note="Description of Artificial Sequence: Synthetic polynucleotide"

SEQ ID NO: 5019 - DNA, 495 bp, Artificial Sequence; identical to SEQ ID NO: 2739
  source: /note="Description of Artificial Sequence: Synthetic polynucleotide"

SEQ ID NO: 5020 - DNA, 495 bp, Artificial Sequence; identical to SEQ ID NO: 2740
  source: /note="Description of Artificial Sequence: Synthetic polynucleotide"

SEQ ID NO: 5021 - DNA, 495 bp, Artificial Sequence; identical to SEQ ID NO: 2741
  source: /note="Description of Artificial Sequence: Synthetic polynucleotide"

SEQ ID NO: 5022 - DNA, 495 bp, Artificial Sequence; identical to SEQ ID NO: 2742
  source: /note="Description of Artificial Sequence: Synthetic polynucleotide"

SEQ ID NO: 5023 - DNA, 495 bp, Artificial Sequence; identical to SEQ ID NO: 2743
  source: /note="Description of Artificial Sequence: Synthetic polynucleotide"

SEQ ID NO: 5024 - DNA, 495 bp, Artificial Sequence; identical to SEQ ID NO: 2744
  source: /note="Description of Artificial Sequence: Synthetic polynucleotide"

SEQ ID NO: 5025 - DNA, 495 bp, Artificial Sequence; identical to SEQ ID NO: 2745
  source: /note="Description of Artificial Sequence: Synthetic polynucleotide"

SEQ ID NO: 5026 - DNA, 495 bp, Artificial Sequence; identical to SEQ ID NO: 2746
  source: /note="Description of Artificial Sequence: Synthetic polynucleotide"

SEQ ID NO: 5027 - DNA, 495 bp, Artificial Sequence; identical to SEQ ID NO: 2747
  source: /note="Description of Artificial Sequence: Synthetic polynucleotide"

SEQ ID NO: 5028 - DNA, 495 bp, Artificial Sequence; identical to SEQ ID NO: 2748
  source: /note="Description of Artificial Sequence: Synthetic polynucleotide"

SEQ ID NO: 5029 - DNA, 495 bp, Artificial Sequence; identical to SEQ ID NO: 2749
  source: /note="Description of Artificial Sequence: Synthetic polynucleotide"

SEQ ID NO: 5030 - DNA, 495 bp, Artificial Sequence; identical to SEQ ID NO: 2750
  source: /note="Description of Artificial Sequence: Synthetic polynucleotide"

SEQ ID NO: 5031 - DNA, 495 bp, Artificial Sequence; identical to SEQ ID NO: 2751
  source: /note="Description of Artificial Sequence: Synthetic polynucleotide"

SEQ ID NO: 5032 - DNA, 495 bp, Artificial Sequence; identical to SEQ ID NO: 2752
  source: /note="Description of Artificial Sequence: Synthetic polynucleotide"

SEQ ID NO: 5033 - DNA, 495 bp, Artificial Sequence; identical to SEQ ID NO: 2753
  source: /note="Description of Artificial Sequence: Synthetic polynucleotide"

SEQ ID NO: 5034 - DNA, 495 bp, Artificial Sequence; identical to SEQ ID NO: 2754
  source: /note="Description of Artificial Sequence: Synthetic polynucleotide"

SEQ ID NO: 5035 - DNA, 495 bp, Artificial Sequence; identical to SEQ ID NO: 2755
  source: /note="Description of Artificial Sequence: Synthetic polynucleotide"

SEQ ID NO: 5036 - DNA, 495 bp, Artificial Sequence; identical to SEQ ID NO: 2756
  source: /note="Description of Artificial Sequence: Synthetic polynucleotide"

SEQ ID NO: 5037 - DNA, 495 bp, Artificial Sequence; identical to SEQ ID NO: 2757
  source: /note="Description of Artificial Sequence: Synthetic polynucleotide"

SEQ ID NO: 5038 - DNA, 495 bp, Artificial Sequence; identical to SEQ ID NO: 2758
  source: /note="Description of Artificial Sequence: Synthetic polynucleotide"

SEQ ID NO: 5039 - DNA, 495 bp, Artificial Sequence; identical to SEQ ID NO: 2759
  source: /note="Description of Artificial Sequence: Synthetic polynucleotide"

SEQ ID NO: 5040 - DNA, 495 bp, Artificial Sequence; identical to SEQ ID NO: 2760
  source: /note="Description of Artificial Sequence: Synthetic polynucleotide"

SEQ ID NO: 5041 - DNA, 495 bp, Artificial Sequence; identical to SEQ ID NO: 2761
  source: /note="Description of Artificial Sequence: Synthetic polynucleotide"

SEQ ID NO: 5042 - DNA, 495 bp, Artificial Sequence; identical to SEQ ID NO: 2762
  source: /note="Description of Artificial Sequence: Synthetic polynucleotide"

SEQ ID NO: 5043 - DNA, 495 bp, Artificial Sequence; identical to SEQ ID NO: 2763
  source: /note="Description of Artificial Sequence: Synthetic polynucleotide"

SEQ ID NO: 5044 - DNA, 495 bp, Artificial Sequence; identical to SEQ ID NO: 2764
  source: /note="Description of Artificial Sequence: Synthetic polynucleotide"

SEQ ID NO: 5045 - DNA, 495 bp, Artificial Sequence; identical to SEQ ID NO: 2765
  source: /note="Description of Artificial Sequence: Synthetic polynucleotide"

SEQ ID NO: 5046 - DNA, 495 bp, Artificial Sequence; identical to SEQ ID NO: 2766
  source: /note="Description of Artificial Sequence: Synthetic polynucleotide"

SEQ ID NO: 5047 - DNA, 495 bp, Artificial Sequence; identical to SEQ ID NO: 2767
  source: /note="Description of Artificial Sequence: Synthetic polynucleotide"

SEQ ID NO: 5048 - DNA, 495 bp, Artificial Sequence; identical to SEQ ID NO: 2768
  source: /note="Description of Artificial Sequence: Synthetic polynucleotide"

SEQ ID NO: 5049 - DNA, 495 bp, Artificial Sequence; identical to SEQ ID NO: 2769
  source: /note="Description of Artificial Sequence: Synthetic polynucleotide"

SEQ ID NO: 5050 - DNA, 495 bp, Artificial Sequence; identical to SEQ ID NO: 2770
  source: /note="Description of Artificial Sequence: Synthetic polynucleotide"

SEQ ID NO: 5051 - DNA, 495 bp, Artificial Sequence; identical to SEQ ID NO: 2771
  source: /note="Description of Artificial Sequence: Synthetic polynucleotide"

SEQ ID NO: 5052 - DNA, 495 bp, Artificial Sequence; identical to SEQ ID NO: 2772
  source: /note="Description of Artificial Sequence: Synthetic polynucleotide"

SEQ ID NO: 5053 - DNA, 495 bp, Artificial Sequence; identical to SEQ ID NO: 2773
  source: /note="Description of Artificial Sequence: Synthetic polynucleotide"

SEQ ID NO: 5054 - DNA, 495 bp, Artificial Sequence; identical to SEQ ID NO: 2774
  source: /note="Description of Artificial Sequence: Synthetic polynucleotide"

SEQ ID NO: 5055 - DNA, 495 bp, Artificial Sequence; identical to SEQ ID NO: 2775
  source: /note="Description of Artificial Sequence: Synthetic polynucleotide"

SEQ ID NO: 5056 - DNA, 495 bp, Artificial Sequence; identical to SEQ ID NO: 2776
  source: /note="Description of Artificial Sequence: Synthetic polynucleotide"

SEQ ID NO: 5057 - DNA, 495 bp, Artificial Sequence; identical to SEQ ID NO: 2777
  source: /note="Description of Artificial Sequence: Synthetic polynucleotide"

SEQ ID NO: 5058 - DNA, 495 bp, Artificial Sequence; identical to SEQ ID NO: 2778
  source: /note="Description of Artificial Sequence: Synthetic polynucleotide"

SEQ ID NO: 5059 - DNA, 495 bp, Artificial Sequence; identical to SEQ ID NO: 2779
  source: /note="Description of Artificial Sequence: Synthetic polynucleotide"

SEQ ID NO: 5060 - DNA, 495 bp, Artificial Sequence; identical to SEQ ID NO: 2780
  source: /note="Description of Artificial Sequence: Synthetic polynucleotide"

SEQ ID NO: 5061 - DNA, 495 bp, Artificial Sequence; identical to SEQ ID NO: 2781
  source: /note="Description of Artificial Sequence: Synthetic polynucleotide"

SEQ ID NO: 5062 - DNA, 495 bp, Artificial Sequence; identical to SEQ ID NO: 2782
  source: /note="Description of Artificial Sequence: Synthetic polynucleotide"

SEQ ID NO: 5063 - DNA, 495 bp, Artificial Sequence; identical to SEQ ID NO: 2783
  source: /note="Description of Artificial Sequence: Synthetic polynucleotide"

SEQ ID NO: 5064 - DNA, 495 bp, Artificial Sequence; identical to SEQ ID NO: 2784
  source: /note="Description of Artificial Sequence: Synthetic polynucleotide"

SEQ ID NO: 5065 - DNA, 495 bp, Artificial Sequence; identical to SEQ ID NO: 2785
  source: /note="Description of Artificial Sequence: Synthetic polynucleotide"

SEQ ID NO: 5066 - DNA, 495 bp, Artificial Sequence; identical to SEQ ID NO: 2786
  source: /note="Description of Artificial Sequence: Synthetic polynucleotide"

SEQ ID NO: 5067 - DNA, 495 bp, Artificial Sequence; identical to SEQ ID NO: 2787
  source: /note="Description of Artificial Sequence: Synthetic polynucleotide"

SEQ ID NO: 5068 - DNA, 495 bp, Artificial Sequence; identical to SEQ ID NO: 2788
  source: /note="Description of Artificial Sequence: Synthetic polynucleotide"

SEQ ID NO: 5069 - DNA, 495 bp, Artificial Sequence; identical to SEQ ID NO: 2789
  source: /note="Description of Artificial Sequence: Synthetic polynucleotide"

SEQ ID NO: 5070 - DNA, 495 bp, Artificial Sequence; identical to SEQ ID NO: 2790
  source: /note="Description of Artificial Sequence: Synthetic polynucleotide"

SEQ ID NO: 5071 - DNA, 495 bp, Artificial Sequence; identical to SEQ ID NO: 2791
  source: /note="Description of Artificial Sequence: Synthetic polynucleotide"

SEQ ID NO: 5072 - DNA, 495 bp, Artificial Sequence; identical to SEQ ID NO: 2792
  source: /note="Description of Artificial Sequence: Synthetic polynucleotide"

SEQ ID NO: 5073 - DNA, 495 bp, Artificial Sequence; identical to SEQ ID NO: 2793
  source: /note="Description of Artificial Sequence: Synthetic polynucleotide"

SEQ ID NO: 5074 - DNA, 495 bp, Artificial Sequence; identical to SEQ ID NO: 2794
  source: /note="Description of Artificial Sequence: Synthetic polynucleotide"

SEQ ID NO: 5075 - DNA, 448 bp, Artificial Sequence; identical to SEQ ID NO: 2795
  source: /note="Description of Artificial Sequence: Synthetic polynucleotide"

SEQ ID NO: 5076 - DNA, 495 bp, Artificial Sequence; identical to SEQ ID NO: 2796
  source: /note="Description of Artificial Sequence: Synthetic polynucleotide"

SEQ ID NO: 5077 - DNA, 495 bp, Artificial Sequence; identical to SEQ ID NO: 2797
  source: /note="Description of Artificial Sequence: Synthetic polynucleotide"

SEQ ID NO: 5078 - DNA, 495 bp, Artificial Sequence; identical to SEQ ID NO: 2798
  source: /note="Description of Artificial Sequence: Synthetic polynucleotide"

SEQ ID NO: 5079 - DNA, 495 bp, Artificial Sequence; identical to SEQ ID NO: 2799
  source: /note="Description of Artificial Sequence: Synthetic polynucleotide"

SEQ ID NO: 5080 - DNA, 495 bp, Artificial Sequence; identical to SEQ ID NO: 2800
  source: /note="Description of Artificial Sequence: Synthetic polynucleotide"

SEQ ID NO: 5081 - DNA, 495 bp, Artificial Sequence; identical to SEQ ID NO: 2801
  source: /note="Description of Artificial Sequence: Synthetic polynucleotide"

SEQ ID NO: 5082 - DNA, 495 bp, Artificial Sequence; identical to SEQ ID NO: 2802
  source: /note="Description of Artificial Sequence: Synthetic polynucleotide"

SEQ ID NO: 5083 - DNA, 495 bp, Artificial Sequence; identical to SEQ ID NO: 2803
  source: /note="Description of Artificial Sequence: Synthetic polynucleotide"

SEQ ID NO: 5084 - DNA, 495 bp, Artificial Sequence; identical to SEQ ID NO: 2804
  source: /note="Description of Artificial Sequence: Synthetic polynucleotide"

SEQ ID NO: 5085 - DNA, 495 bp, Artificial Sequence; identical to SEQ ID NO: 2805
  source: /note="Description of Artificial Sequence: Synthetic polynucleotide"

SEQ ID NO: 5086 - DNA, 495 bp, Artificial Sequence; identical to SEQ ID NO: 2806
  source: /note="Description of Artificial Sequence: Synthetic polynucleotide"

SEQ ID NO: 5087 - DNA, 495 bp, Artificial Sequence; identical to SEQ ID NO: 2807
  source: /note="Description of Artificial Sequence: Synthetic polynucleotide"

SEQ ID NO: 5088 - DNA, 495 bp, Artificial Sequence; identical to SEQ ID NO: 2808
  source: /note="Description of Artificial Sequence: Synthetic polynucleotide"

SEQ ID NO: 5089 - DNA, 495 bp, Artificial Sequence; identical to SEQ ID NO: 2809
  source: /note="Description of Artificial Sequence: Synthetic polynucleotide"

SEQ ID NO: 5090 - DNA, 495 bp, Artificial Sequence; identical to SEQ ID NO: 2810
  source: /note="Description of Artificial Sequence: Synthetic polynucleotide"

SEQ ID NO: 5091 - DNA, 495 bp, Artificial Sequence; identical to SEQ ID NO: 2811
  source: /note="Description of Artificial Sequence: Synthetic polynucleotide"

SEQ ID NO: 5092 - DNA, 495 bp, Artificial Sequence; identical to SEQ ID NO: 2812
  source: /note="Description of Artificial Sequence: Synthetic polynucleotide"

SEQ ID NO: 5093 - DNA, 495 bp, Artificial Sequence; identical to SEQ ID NO: 2813
  source: /note="Description of Artificial Sequence: Synthetic polynucleotide"

SEQ ID NO: 5094 - DNA, 495 bp, Artificial Sequence; identical to SEQ ID NO: 2814
  source: /note="Description of Artificial Sequence: Synthetic polynucleotide"

SEQ ID NO: 5095 - DNA, 495 bp, Artificial Sequence; identical to SEQ ID NO: 2815
  source: /note="Description of Artificial Sequence: Synthetic polynucleotide"

SEQ ID NO: 5096 - DNA, 495 bp, Artificial Sequence; identical to SEQ ID NO: 2816
  source: /note="Description of Artificial Sequence: Synthetic polynucleotide"

SEQ ID NO: 5097 - DNA, 495 bp, Artificial Sequence; identical to SEQ ID NO: 2817
  source: /note="Description of Artificial Sequence: Synthetic polynucleotide"

SEQ ID NO: 5098 - DNA, 495 bp, Artificial Sequence; identical to SEQ ID NO: 2818
  source: /note="Description of Artificial Sequence: Synthetic polynucleotide"

SEQ ID NO: 5099 - DNA, 495 bp, Artificial Sequence; identical to SEQ ID NO: 2819
  source: /note="Description of Artificial Sequence: Synthetic polynucleotide"

SEQ ID NO: 5100 - DNA, 495 bp, Artificial Sequence; identical to SEQ ID NO: 2820
  source: /note="Description of Artificial Sequence: Synthetic polynucleotide"

SEQ ID NO: 5101 - DNA, 495 bp, Artificial Sequence; identical to SEQ ID NO: 2821
  source: /note="Description of Artificial Sequence: Synthetic polynucleotide"

SEQ ID NO: 5102 - DNA, 495 bp, Artificial Sequence; identical to SEQ ID NO: 2822
  source: /note="Description of Artificial Sequence: Synthetic polynucleotide"

SEQ ID NO: 5103 - DNA, 495 bp, Artificial Sequence; identical to SEQ ID NO: 2823
  source: /note="Description of Artificial Sequence: Synthetic polynucleotide"

SEQ ID NO: 5104 - DNA, 495 bp, Artificial Sequence; identical to SEQ ID NO: 2824
  source: /note="Description of Artificial Sequence: Synthetic polynucleotide"

SEQ ID NO: 5105 - DNA, 495 bp, Artificial Sequence; identical to SEQ ID NO: 2825
  source: /note="Description of Artificial Sequence: Synthetic polynucleotide"

SEQ ID NO: 5106 - DNA, 495 bp, Artificial Sequence; identical to SEQ ID NO: 2826
  source: /note="Description of Artificial Sequence: Synthetic polynucleotide"

SEQ ID NO: 5107 - DNA, 495 bp, Artificial Sequence; identical to SEQ ID NO: 2827
  source: /note="Description of Artificial Sequence: Synthetic polynucleotide"

SEQ ID NO: 5108 - DNA, 495 bp, Artificial Sequence; identical to SEQ ID NO: 2828
  source: /note="Description of Artificial Sequence: Synthetic polynucleotide"

SEQ ID NO: 5109 - DNA, 495 bp, Artificial Sequence; identical to SEQ ID NO: 2829
  source: /note="Description of Artificial Sequence: Synthetic polynucleotide"

SEQ ID NO: 5110 - DNA, 495 bp, Artificial Sequence; identical to SEQ ID NO: 2830
  source: /note="Description of Artificial Sequence: Synthetic polynucleotide"

SEQ ID NO: 5111 - DNA, 495 bp, Artificial Sequence; identical to SEQ ID NO: 2831
  source: /note="Description of Artificial Sequence: Synthetic polynucleotide"

SEQ ID NO: 5112 - DNA, 495 bp, Artificial Sequence; identical to SEQ ID NO: 2832
  source: /note="Description of Artificial Sequence: Synthetic polynucleotide"

SEQ ID NO: 5113 - DNA, 495 bp, Artificial Sequence; identical to SEQ ID NO: 2833
  source: /note="Description of Artificial Sequence: Synthetic polynucleotide"

SEQ ID NO: 5114 - DNA, 495 bp, Artificial Sequence; identical to SEQ ID NO: 2834
  source: /note="Description of Artificial Sequence: Synthetic polynucleotide"

SEQ ID NO: 5115 - DNA, 495 bp, Artificial Sequence; identical to SEQ ID NO: 2835
  source: /note="Description of Artificial Sequence: Synthetic polynucleotide"

SEQ ID NO: 5116 - DNA, 495 bp, Artificial Sequence; identical to SEQ ID NO: 2836
  source: /note="Description of Artificial Sequence: Synthetic polynucleotide"

SEQ ID NO: 5117 - DNA, 495 bp, Artificial Sequence; identical to SEQ ID NO: 2837
  source: /note="Description of Artificial Sequence: Synthetic polynucleotide"

SEQ ID NO: 5118 - DNA, 495 bp, Artificial Sequence; identical to SEQ ID NO: 2838
  source: /note="Description of Artificial Sequence: Synthetic polynucleotide"

SEQ ID NO: 5119 - DNA, 495 bp, Artificial Sequence; identical to SEQ ID NO: 2839
  source: /note="Description of Artificial Sequence: Synthetic polynucleotide"

SEQ ID NO: 5120 - DNA, 495 bp, Artificial Sequence; identical to SEQ ID NO: 2840
  source: /note="Description of Artificial Sequence: Synthetic polynucleotide"

SEQ ID NO: 5121 - DNA, 495 bp, Artificial Sequence; identical to SEQ ID NO: 2841
  source: /note="Description of Artificial Sequence: Synthetic polynucleotide"

SEQ ID NO: 5122 - DNA, 495 bp, Artificial Sequence; identical to SEQ ID NO: 2842
  source: /note="Description of Artificial Sequence: Synthetic polynucleotide"

SEQ ID NO: 5123 - DNA, 495 bp, Artificial Sequence; identical to SEQ ID NO: 2843
  source: /note="Description of Artificial Sequence: Synthetic polynucleotide"

SEQ ID NO: 5124 - DNA, 495 bp, Artificial Sequence; identical to SEQ ID NO: 2844
  source: /note="Description of Artificial Sequence: Synthetic polynucleotide"

SEQ ID NO: 5125 - DNA, 495 bp, Artificial Sequence; identical to SEQ ID NO: 2845
  source: /note="Description of Artificial Sequence: Synthetic polynucleotide"

SEQ ID NO: 5126 - DNA, 495 bp, Artificial Sequence; identical to SEQ ID NO: 2846
  source: /note="Description of Artificial Sequence: Synthetic polynucleotide"

SEQ ID NO: 5127 - DNA, 495 bp, Artificial Sequence; identical to SEQ ID NO: 2847
  source: /note="Description of Artificial Sequence: Synthetic polynucleotide"

SEQ ID NO: 5128 - DNA, 495 bp, Artificial Sequence; identical to SEQ ID NO: 2848
  source: /note="Description of Artificial Sequence: Synthetic polynucleotide"

SEQ ID NO: 5129 - DNA, 495 bp, Artificial Sequence; identical to SEQ ID NO: 2849
  source: /note="Description of Artificial Sequence: Synthetic polynucleotide"

SEQ ID NO: 5130 - DNA, 495 bp, Artificial Sequence; identical to SEQ ID NO: 2850
  source: /note="Description of Artificial Sequence: Synthetic polynucleotide"

SEQ ID NO: 5131 - DNA, 495 bp, Artificial Sequence; identical to SEQ ID NO: 2851
  source: /note="Description of Artificial Sequence: Synthetic polynucleotide"

SEQ ID NO: 5132 - DNA, 495 bp, Artificial Sequence; identical to SEQ ID NO: 2852
  source: /note="Description of Artificial Sequence: Synthetic polynucleotide"

SEQ ID NO: 5133 - DNA, 495 bp, Artificial Sequence; identical to SEQ ID NO: 2853
  source: /note="Description of Artificial Sequence: Synthetic polynucleotide"

SEQ ID NO: 5134 - DNA, 495 bp, Artificial Sequence; identical to SEQ ID NO: 2854
  source: /note="Description of Artificial Sequence: Synthetic polynucleotide"

SEQ ID NO: 5135 - DNA, 495 bp, Artificial Sequence; identical to SEQ ID NO: 2855
  source: /note="Description of Artificial Sequence: Synthetic polynucleotide"

SEQ ID NO: 5136 - DNA, 495 bp, Artificial Sequence; identical to SEQ ID NO: 2856
  source: /note="Description of Artificial Sequence: Synthetic polynucleotide"

SEQ ID NO: 5137 - DNA, 495 bp, Artificial Sequence; identical to SEQ ID NO: 2857
  source: /note="Description of Artificial Sequence: Synthetic polynucleotide"

SEQ ID NO: 5138 - DNA, 495 bp, Artificial Sequence; identical to SEQ ID NO: 2858
  source: /note="Description of Artificial Sequence: Synthetic polynucleotide"

SEQ ID NO: 5139 - DNA, 495 bp, Artificial Sequence; identical to SEQ ID NO: 2859
  source: /note="Description of Artificial Sequence: Synthetic polynucleotide"

SEQ ID NO: 5140 - DNA, 495 bp, Artificial Sequence; identical to SEQ ID NO: 2860
  source: /note="Description of Artificial Sequence: Synthetic polynucleotide"

SEQ ID NO: 5141 - DNA, 495 bp, Artificial Sequence; identical to SEQ ID NO: 2861
  source: /note="Description of Artificial Sequence: Synthetic polynucleotide"

SEQ ID NO: 5142 - DNA, 495 bp, Artificial Sequence; identical to SEQ ID NO: 2862
  source: /note="Description of Artificial Sequence: Synthetic polynucleotide"

SEQ ID NO: 5143 - DNA, 495 bp, Artificial Sequence; identical to SEQ ID NO: 2863
  source: /note="Description of Artificial Sequence: Synthetic polynucleotide"

SEQ ID NO: 5144 - DNA, 495 bp, Artificial Sequence; identical to SEQ ID NO: 2864
  source: /note="Description of Artificial Sequence: Synthetic polynucleotide"

SEQ ID NO: 5145 - DNA, 495 bp, Artificial Sequence; identical to SEQ ID NO: 2865
  source: /note="Description of Artificial Sequence: Synthetic polynucleotide"

SEQ ID NO: 5146 - DNA, 495 bp, Artificial Sequence; identical to SEQ ID NO: 2866
  source: /note="Description of Artificial Sequence: Synthetic polynucleotide"

SEQ ID NO: 5147 - DNA, 495 bp, Artificial Sequence; identical to SEQ ID NO: 2867
  source: /note="Description of Artificial Sequence: Synthetic polynucleotide"

SEQ ID NO: 5148 - DNA, 495 bp, Artificial Sequence; identical to SEQ ID NO: 2868
  source: /note="Description of Artificial Sequence: Synthetic polynucleotide"

SEQ ID NO: 5149 - DNA, 495 bp, Artificial Sequence; identical to SEQ ID NO: 2869
  source: /note="Description of Artificial Sequence: Synthetic polynucleotide"

SEQ ID NO: 5150 - DNA, 495 bp, Artificial Sequence; identical to SEQ ID NO: 2870
  source: /note="Description of Artificial Sequence: Synthetic polynucleotide"

SEQ ID NO: 5151 - DNA, 495 bp, Artificial Sequence; identical to SEQ ID NO: 2871
  source: /note="Description of Artificial Sequence: Synthetic polynucleotide"

SEQ ID NO: 5152 - DNA, 495 bp, Artificial Sequence; identical to SEQ ID NO: 2872
  source: /note="Description of Artificial Sequence: Synthetic polynucleotide"

SEQ ID NO: 5153 - DNA, 495 bp, Artificial Sequence; identical to SEQ ID NO: 2873
  source: /note="Description of Artificial Sequence: Synthetic polynucleotide"

SEQ ID NO: 5154 - DNA, 495 bp, Artificial Sequence; identical to SEQ ID NO: 2874
  source: /note="Description of Artificial Sequence: Synthetic polynucleotide"

SEQ ID NO: 5155 - DNA, 495 bp, Artificial Sequence; identical to SEQ ID NO: 2875
  source: /note="Description of Artificial Sequence: Synthetic polynucleotide"

SEQ ID NO: 5156 - DNA, 495 bp, Artificial Sequence; identical to SEQ ID NO: 2876
  source: /note="Description of Artificial Sequence: Synthetic polynucleotide"

SEQ ID NO: 5157 - DNA, 495 bp, Artificial Sequence; identical to SEQ ID NO: 2877
  source: /note="Description of Artificial Sequence: Synthetic polynucleotide"

SEQ ID NO: 5158 - DNA, 495 bp, Artificial Sequence; identical to SEQ ID NO: 2878
  source: /note="Description of Artificial Sequence: Synthetic polynucleotide"

SEQ ID NO: 5159 - DNA, 495 bp, Artificial Sequence; identical to SEQ ID NO: 2879
  source: /note="Description of Artificial Sequence: Synthetic polynucleotide"

SEQ ID NO: 5160 - DNA, 495 bp, Artificial Sequence; identical to SEQ ID NO: 2880
  source: /note="Description of Artificial Sequence: Synthetic polynucleotide"

SEQ ID NO: 5161 - DNA, 495 bp, Artificial Sequence; identical to SEQ ID NO: 2881
  source: /note="Description of Artificial Sequence: Synthetic polynucleotide"

SEQ ID NO: 5162 - DNA, 495 bp, Artificial Sequence; identical to SEQ ID NO: 2882
  source: /note="Description of Artificial Sequence: Synthetic polynucleotide"

SEQ ID NO: 5163 - DNA, 495 bp, Artificial Sequence; identical to SEQ ID NO: 2883
  source: /note="Description of Artificial Sequence: Synthetic polynucleotide"

SEQ ID NO: 5164 - DNA, 495 bp, Artificial Sequence; identical to SEQ ID NO: 2884
  source: /note="Description of Artificial Sequence: Synthetic polynucleotide"

SEQ ID NO: 5165 - DNA, 495 bp, Artificial Sequence; identical to SEQ ID NO: 2885
  source: /note="Description of Artificial Sequence: Synthetic polynucleotide"

SEQ ID NO: 5166 - DNA, 495 bp, Artificial Sequence; identical to SEQ ID NO: 2886
  source: /note="Description of Artificial Sequence: Synthetic polynucleotide"

SEQ ID NO: 5167 - DNA, 495 bp, Artificial Sequence; identical to SEQ ID NO: 2887
  source: /note="Description of Artificial Sequence: Synthetic polynucleotide"

SEQ ID NO: 5168 - DNA, 495 bp, Artificial Sequence; identical to SEQ ID NO: 2888
  source: /note="Description of Artificial Sequence: Synthetic polynucleotide"

SEQ ID NO: 5169 - DNA, 495 bp, Artificial Sequence; identical to SEQ ID NO: 2889
  source: /note="Description of Artificial Sequence: Synthetic polynucleotide"

SEQ ID NO: 5170 - DNA, 495 bp, Artificial Sequence; identical to SEQ ID NO: 2890
  source: /note="Description of Artificial Sequence: Synthetic polynucleotide"

SEQ ID NO: 5171 - DNA, 495 bp, Artificial Sequence; identical to SEQ ID NO: 2891
  source: /note="Description of Artificial Sequence: Synthetic polynucleotide"

SEQ ID NO: 5172 - DNA, 495 bp, Artificial Sequence; identical to SEQ ID NO: 2892
  source: /note="Description of Artificial Sequence: Synthetic polynucleotide"

SEQ ID NO: 5173 - DNA, 495 bp, Artificial Sequence; identical to SEQ ID NO: 2893
  source: /note="Description of Artificial Sequence: Synthetic polynucleotide"

SEQ ID NO: 5174 - DNA, 495 bp, Artificial Sequence; identical to SEQ ID NO: 2894
  source: /note="Description of Artificial Sequence: Synthetic polynucleotide"

SEQ ID NO: 5175 - DNA, 495 bp, Artificial Sequence; identical to SEQ ID NO: 2895
  source: /note="Description of Artificial Sequence: Synthetic polynucleotide"

SEQ ID NO: 5176 - DNA, 495 bp, Artificial Sequence; identical to SEQ ID NO: 2896
  source: /note="Description of Artificial Sequence: Synthetic polynucleotide"

SEQ ID NO: 5177 - DNA, 495 bp, Artificial Sequence; identical to SEQ ID NO: 2897
  source: /note="Description of Artificial Sequence: Synthetic polynucleotide"

SEQ ID NO: 5178 - DNA, 495 bp, Artificial Sequence; identical to SEQ ID NO: 2898
  source: /note="Description of Artificial Sequence: Synthetic polynucleotide"

SEQ ID NO: 5179 - DNA, 495 bp, Artificial Sequence; identical to SEQ ID NO: 2899
  source: /note="Description of Artificial Sequence: Synthetic polynucleotide"

SEQ ID NO: 5180 - DNA, 495 bp, Artificial Sequence; identical to SEQ ID NO: 2900
  source: /note="Description of Artificial Sequence: Synthetic polynucleotide"

SEQ ID NO: 5181 - DNA, 495 bp, Artificial Sequence; identical to SEQ ID NO: 2901
  source: /note="Description of Artificial Sequence: Synthetic polynucleotide"

SEQ ID NO: 5182 - DNA, 495 bp, Artificial Sequence; identical to SEQ ID NO: 2902
  source: /note="Description of Artificial Sequence: Synthetic polynucleotide"

SEQ ID NO: 5183 - DNA, 495 bp, Artificial Sequence; identical to SEQ ID NO: 2903
  source: /note="Description of Artificial Sequence: Synthetic polynucleotide"

SEQ ID NO: 5184 - DNA, 495 bp, Artificial Sequence; identical to SEQ ID NO: 2904
  source: /note="Description of Artificial Sequence: Synthetic polynucleotide"

SEQ ID NO: 5185 - DNA, 495 bp, Artificial Sequence; identical to SEQ ID NO: 2905
  source: /note="Description of Artificial Sequence: Synthetic polynucleotide"

SEQ ID NO: 5186 - DNA, 495 bp, Artificial Sequence; identical to SEQ ID NO: 2906
  source: /note="Description of Artificial Sequence: Synthetic polynucleotide"

SEQ ID NO: 5187 - DNA, 495 bp, Artificial Sequence; identical to SEQ ID NO: 2907
  source: /note="Description of Artificial Sequence: Synthetic polynucleotide"

SEQ ID NO: 5188 - DNA, 495 bp, Artificial Sequence; identical to SEQ ID NO: 2908
  source: /note="Description of Artificial Sequence: Synthetic polynucleotide"

SEQ ID NO: 5189 - DNA, 495 bp, Artificial Sequence; identical to SEQ ID NO: 2909
  source: /note="Description of Artificial Sequence: Synthetic polynucleotide"

SEQ ID NO: 5190 - DNA, 495 bp, Artificial Sequence; identical to SEQ ID NO: 2910
  source: /note="Description of Artificial Sequence: Synthetic polynucleotide"

SEQ ID NO: 5191 - DNA, 495 bp, Artificial Sequence; identical to SEQ ID NO: 2911
  source: /note="Description of Artificial Sequence: Synthetic polynucleotide"

SEQ ID NO: 5192 - DNA, 495 bp, Artificial Sequence; identical to SEQ ID NO: 2912
  source: /note="Description of Artificial Sequence: Synthetic polynucleotide"

SEQ ID NO: 5193 - DNA, 495 bp, Artificial Sequence; identical to SEQ ID NO: 2913
  source: /note="Description of Artificial Sequence: Synthetic polynucleotide"

SEQ ID NO: 5194 - DNA, 495 bp, Artificial Sequence; identical to SEQ ID NO: 2914
  source: /note="Description of Artificial Sequence: Synthetic polynucleotide"

SEQ ID NO: 5195 - DNA, 495 bp, Artificial Sequence; identical to SEQ ID NO: 2915
  source: /note="Description of Artificial Sequence: Synthetic polynucleotide"

SEQ ID NO: 5196 - DNA, 495 bp, Artificial Sequence; identical to SEQ ID NO: 2916
  source: /note="Description of Artificial Sequence: Synthetic polynucleotide"

SEQ ID NO: 5197 - DNA, 495 bp, Artificial Sequence; identical to SEQ ID NO: 2917
  source: /note="Description of Artificial Sequence: Synthetic polynucleotide"

SEQ ID NO: 5198 - DNA, 495 bp, Artificial Sequence; identical to SEQ ID NO: 2918
  source: /note="Description of Artificial Sequence: Synthetic polynucleotide"

SEQ ID NO: 5199 - DNA, 448 bp, Artificial Sequence; identical to SEQ ID NO: 2919
  source: /note="Description of Artificial Sequence: Synthetic polynucleotide"

SEQ ID NO: 5200 - DNA, 495 bp, Artificial Sequence; identical to SEQ ID NO: 2920
  source: /note="Description of Artificial Sequence: Synthetic polynucleotide"

SEQ ID NO: 5201 - DNA, 49 bp, Artificial Sequence
  source: /note="Description of Artificial Sequence: Synthetic primer"
gggctggcaagccacgtttggtgagcccccagggaagaagctgaagtgg

SEQ ID NO: 5202 - DNA, 49 bp, Artificial Sequence
  source: /note="Description of Artificial Sequence: Synthetic primer"
gggctggcaagccacgtttggtgaggctccagggaatgggctggagttg

SEQ ID NO: 5203 - DNA, 49 bp, Artificial Sequence
  source: /note="Description of Artificial Sequence: Synthetic primer"
gggctggcaagccacgtttggtgaggcttcaggacaggggttggtgtgg

SEQ ID NO: 5204 - DNA, 49 bp, Artificial Sequence
  source: /note="Description of Artificial Sequence: Synthetic primer"
gggctggcaagccacgtttggtgaggcttcatgacaggggtgggtgtgg

SEQ ID NO: 5205 - DNA, 50 bp, Artificial Sequence
  source: /note="Description of Artificial Sequence: Synthetic primer"
gggctggcaagccacgtttggtgcaagctccagggaagggactggagtgg

SEQ ID NO: 5206 - DNA, 54 bp, Artificial Sequence
  source: /note="Description of Artificial Sequence: Synthetic primer"
gggctggcaagccacgtttggtgcaatgagactctagggaaggggctggaggga

SEQ ID NO: 5207 - DNA, 46 bp, Artificial Sequence
  source: /note="Description of Artificial Sequence: Synthetic primer"
gggctggcaagccacgtttggtgcaccagggaagggcctggagtgg

SEQ ID NO: 5208 - DNA, 53 bp, Artificial Sequence
  source: /note="Description of Artificial Sequence: Synthetic primer"
gggctggcaagccacgtttggtgcacgagtccacatgggaaggactggagtgg

SEQ ID NO: 5209 - DNA, 47 bp, Artificial Sequence
  source: /note="Description of Artificial Sequence: Synthetic primer"
gggctggcaagccacgtttggtgcactagcccgcttccatgggctgt

SEQ ID NO: 5210 - DNA, 53 bp, Artificial Sequence
  source: /note="Description of Artificial Sequence: Synthetic primer"
gggctggcaagccacgtttggtgcagcaggcttcacaacagggattgtggtgg

SEQ ID NO: 5211 - DNA, 53 bp, Artificial Sequence
  source: /note="Description of Artificial Sequence: Synthetic primer"
gggctggcaagccacgtttggtgcagcaggcttcatgacagggattggtgtgg

SEQ ID NO: 5212 - DNA, 50 bp, Artificial Sequence
  source: /note="Description of Artificial Sequence: Synthetic primer"
gggctggcaagccacgtttggtgcaggcccatggacaagggcttgaggaa

SEQ ID NO: 5213 - DNA, 50 bp, Artificial Sequence
  source: /note="Description of Artificial Sequence: Synthetic primer"
gggctggcaagccacgtttggtgcaggctccagggaacagactggagtgg

SEQ ID NO: 5214 - DNA, 50 bp, Artificial Sequence
  source: /note="Description of Artificial Sequence: Synthetic primer"
gggctggcaagccacgtttggtgcaggcttctgggaaagggctggagtgg

SEQ ID NO: 5215 - DNA, 50 bp, Artificial Sequence
  source: /note="Description of Artificial Sequence: Synthetic primer"
gggctggcaagccacgtttggtgcagtccccatcgagaggccttgagtgg

SEQ ID NO: 5216 - DNA, 50 bp, Artificial Sequence
  source: /note="Description of Artificial Sequence: Synthetic primer"
gggctggcaagccacgtttggtgcagtcccctggacaagggcttgagtgg

SEQ ID NO: 5217 - DNA, 53 bp, Artificial Sequence
  source: /note="Description of Artificial Sequence: Synthetic primer"
gggctggcaagccacgtttggtgcatcaggctcctgggaaagggctggagtag

SEQ ID NO: 5218 - DNA, 51 bp, Artificial Sequence
  source: /note="Description of Artificial Sequence: Synthetic primer"
gggctggcaagccacgtttggtgccagatgcccgggaaagaactggagtgg

SEQ ID NO: 5219 - DNA, 54 bp, Artificial Sequence
  source: /note="Description of Artificial Sequence: Synthetic primer"
gggctggcaagccacgtttggtgccagcacgcttcacaacaggaattggtgtgg

SEQ ID NO: 5220 - DNA, 54 bp, Artificial Sequence
  source: /note="Description of Artificial Sequence: Synthetic primer"
gggctggcaagccacgtttggtgccagcacgcttcacaacagggataggtgtgg

SEQ ID NO: 5221 - DNA, 51 bp, Artificial Sequence
  source: /note="Description of Artificial Sequence: Synthetic primer"
gggctggcaagccacgtttggtgccaggctccaggaaagggtttggagtgg

SEQ ID NO: 5222 - DNA, 45 bp, Artificial Sequence
  source: /note="Description of Artificial Sequence: Synthetic primer"
gggctggcaagccacgtttggtgcccagggaaggccctggagtgg

SEQ ID NO: 5223 - DNA, 45 bp, Artificial Sequence
  source: /note="Description of Artificial Sequence: Synthetic primer"
gggctggcaagccacgtttggtgcccagggaagggcctggagtgg

SEQ ID NO: 5224 - DNA, 45 bp, Artificial Sequence
  source: /note="Description of Artificial Sequence: Synthetic primer"
gggctggcaagccacgtttggtgcccagggaaggggctggagtgg

SEQ ID NO: 5225 - DNA, 46 bp, Artificial Sequence
  source: /note="Description of Artificial Sequence: Synthetic primer"
gggctggcaagccacgtttggtgccccaggaaaggccctggagtgg

SEQ ID NO: 5226 - DNA, 46 bp, Artificial Sequence
  source: /note="Description of Artificial Sequence: Synthetic primer"
gggctggcaagccacgtttggtgccccaggacaggggcttgagtgg

SEQ ID NO: 5227 - DNA, 46 bp, Artificial Sequence
  source: /note="Description of Artificial Sequence: Synthetic primer"
gggctggcaagccacgtttggtgccccagggaagggactggagtgg

SEQ ID NO: 5228 - DNA, 46 bp, Artificial Sequence
  source: /note="Description of Artificial Sequence: Synthetic primer"
gggctggcaagccacgtttggtgccccagggaaggggctggaatgg

SEQ ID NO: 5229 - DNA, 47 bp, Artificial Sequence
  source: /note="Description of Artificial Sequence: Synthetic primer"
gggctggcaagccacgtttggtgcccccagggaagggaatggagtgg

SEQ ID NO: 5230 - DNA, 47 bp, Artificial Sequence
  source: /note="Description of Artificial Sequence: Synthetic primer"
gggctggcaagccacgtttggtgccccccaggaagggactggagtga

SEQ ID NO: 5231 - DNA, 46 bp, Artificial Sequence
  source: /note="Description of Artificial Sequence: Synthetic primer"
gggctggcaagccacgtttggtgcccccggacaagcgcttgagtgg

SEQ ID NO: 5232 - DNA, 49 bp, Artificial Sequence
  source: /note="Description of Artificial Sequence: Synthetic primer"
gggctggcaagccacgtttggtgcccctctctgggagggaatggagtgg

SEQ ID NO: 5233 - DNA, 47 bp, Artificial Sequence
  source: /note="Description of Artificial Sequence: Synthetic primer"
gggctggcaagccacgtttggtgcccgtgggcaacaggctggaatgg

SEQ ID NO: 5234 - DNA, 47 bp, Artificial Sequence
  source: /note="Description of Artificial Sequence: Synthetic primer"
gggctggcaagccacgtttggtgccctcagcaaaggccctggagtgg

SEQ ID NO: 5235 - DNA, 46 bp, Artificial Sequence
  source: /note="Description of Artificial Sequence: Synthetic primer"
gggctggcaagccacgtttggtgccgcaaggaagggactggagcga

SEQ ID NO: 5236 - DNA, 54 bp, Artificial Sequence
  source: /note="Description of Artificial Sequence: Synthetic primer"
gggctggcaagccacgtttggtgccgccaagctacaggaaaaggtctggagtgg

SEQ ID NO: 5237 - DNA, 49 bp, Artificial Sequence
  source: /note="Description of Artificial Sequence: Synthetic primer"
gggctggcaagccacgtttggtgccgccagtcctcagtcaagggagtgg

SEQ ID NO: 5238 - DNA, 43 bp, Artificial Sequence
  source: /note="Description of Artificial Sequence: Synthetic primer"
gggctggcaagccacgtttggtgccgggaaggggctggagtgg

SEQ ID NO: 5239 - DNA, 51 bp, Artificial Sequence
  source: /note="Description of Artificial Sequence: Synthetic primer"
gggctggcaagccacgtttggtgccgggcttcaagaaaggggctggaatgg

SEQ ID NO: 5240 - DNA, 44 bp, Artificial Sequence
  source: /note="Description of Artificial Sequence: Synthetic primer"
gggctggcaagccacgtttggtgccggggaagggactggagcga

SEQ ID NO: 5241 - DNA, 61 bp, Artificial Sequence
  source: /note="Description of Artificial Sequence: Synthetic primer"
gggctggcaagccacgtttggtgcctggatccaccatctcccatcaaaaggtcttcagtgt

SEQ ID NO: 5242 - DNA, 53 bp, Artificial Sequence
  source: /note="Description of Artificial Sequence: Synthetic primer"
gggctggcaagccacgtttggtgcgccaggctccaagaaagggtttgtagtgg

SEQ ID NO: 5243 - DNA, 45 bp, Artificial Sequence
  source: /note="Description of Artificial Sequence: Synthetic primer"
gggctggcaagccacgtttggtgcgccgggaagggactggagtgg

SEQ ID NO: 5244 - DNA, 46 bp, Artificial Sequence
  source: /note="Description of Artificial Sequence: Synthetic primer"
gggctggcaagccacgtttggtgctccaggcaaggggctggagtgg

SEQ ID NO: 5245 - DNA, 46 bp, Artificial Sequence
  source: /note="Description of Artificial Sequence: Synthetic primer"
gggctggcaagccacgtttggtgctccagggaagggcctggagtgg

SEQ ID NO: 5246 - DNA, 46 bp, Artificial Sequence
  source: /note="Description of Artificial Sequence: Synthetic primer"
gggctggcaagccacgtttggtgctccagggaaggggctggagtgg

SEQ ID NO: 5247 - DNA, 46 bp, Artificial Sequence
  source: /note="Description of Artificial Sequence: Synthetic primer"
gggctggcaagccacgtttggtgctccagggaaggggctggtgtgg

SEQ ID NO: 5248 - DNA, 46 bp, Artificial Sequence
  source: /note="Description of Artificial Sequence: Synthetic primer"
gggctggcaagccacgtttggtgctccagggaagggtccggagtgg

SEQ ID NO: 5249 - DNA, 48 bp, Artificial Sequence
  source: /note="Description of Artificial Sequence: Synthetic primer"
gggctggcaagccacgtttggtgctccccagggaagggactggagtga

SEQ ID NO: 5250 - DNA, 46 bp, Artificial Sequence
  source: /note="Description of Artificial Sequence: Synthetic primer"
gggctggcaagccacgtttggtgctccggagaaggggctggagtgg

SEQ ID NO: 5251 - DNA, 46 bp, Artificial Sequence
  source: /note="Description of Artificial Sequence: Synthetic primer"
gggctggcaagccacgtttggtgctccggggaagggtctggagtgg

SEQ ID NO: 5252 - DNA, 46 bp, Artificial Sequence
  source: /note="Description of Artificial Sequence: Synthetic primer"
gggctggcaagccacgtttggtgctgcaggcaaggggctggagtga

SEQ ID NO: 5253 - DNA, 54 bp, Artificial Sequence
  source: /note="Description of Artificial Sequence: Synthetic primer"
gggctggcaagccacgtttggtgctgcttgcccctagaagatggacaggagtgg

SEQ ID NO: 5254 - DNA, 43 bp, Artificial Sequence
  source: /note="Description of Artificial Sequence: Synthetic primer"
gggctggcaagccacgtttggtgctgggaaggcgctggggcac

SEQ ID NO: 5255 - DNA, 46 bp, Artificial Sequence
  source: /note="Description of Artificial Sequence: Synthetic primer"
gggctggcaagccacgtttggtgctgggggacagaggctggagtgg

SEQ ID NO: 5256 - DNA, 55 bp, Artificial Sequence
  source: /note="Description of Artificial Sequence: Synthetic primer"
gggctggcaagccacgtttggtgctgtaggcactggatggaaagcacaggagtgg

SEQ ID NO: 5257 - DNA, 52 bp, Artificial Sequence
  source: /note="Description of Artificial Sequence: Synthetic primer"
gggctggcaagccacgtttggtggacaggctcctggaaaagggcttgagtgg

SEQ ID NO: 5258 - DNA, 48 bp, Artificial Sequence
  source: /note="Description of Artificial Sequence: Synthetic primer"
gggctggcaagccacgtttggtggatgcccgggaaaggcttggagtgg

SEQ ID NO: 5259 - DNA, 51 bp, Artificial Sequence
  source: /note="Description of Artificial Sequence: Synthetic primer"
gggctggcaagccacgtttggtggcaggcttcatgacaggggtgggtgtag

SEQ ID NO: 5260 - DNA, 52 bp, Artificial Sequence
  source: /note="Description of Artificial Sequence: Synthetic primer"
gggctggcaagccacgtttggtggccaggctccagggaagggactggaatat

SEQ ID NO: 5261 - DNA, 48 bp, Artificial Sequence
  source: /note="Description of Artificial Sequence: Synthetic primer"
gggctggcaagccacgtttggtggcccccatgggaggtactggagtgg

SEQ ID NO: 5262 - DNA, 47 bp, Artificial Sequence
  source: /note="Description of Artificial Sequence: Synthetic primer"
gggctggcaagccacgtttggtggcccccggacaaaggcttgagtgg

SEQ ID NO: 5263 - DNA, 47 bp, Artificial Sequence
  source: /note="Description of Artificial Sequence: Synthetic primer"
gggctggcaagccacgtttggtggcccctggacaagggcttgagtgg

SEQ ID NO: 5264 - DNA, 45 bp, Artificial Sequence
  source: /note="Description of Artificial Sequence: Synthetic primer"
gggctggcaagccacgtttggtggcccgggaaaggcctggagtgg

SEQ ID NO: 5265 - DNA, 47 bp, Artificial Sequence
  source: /note="Description of Artificial Sequence: Synthetic primer"
gggctggcaagccacgtttggtggcctcagggaaggggctggaatgg

SEQ ID NO: 5266 - DNA, 47 bp, Artificial Sequence
  source: /note="Description of Artificial Sequence: Synthetic primer"
gggctggcaagccacgtttggtggctccaggaaaggggctgcagtga

SEQ ID NO: 5267 - DNA, 47 bp, Artificial Sequence
  source: /note="Description of Artificial Sequence: Synthetic primer"
gggctggcaagccacgtttggtggctccaggaaaggggctggagtgg

SEQ ID NO: 5268 - DNA, 47 bp, Artificial Sequence
  source: /note="Description of Artificial Sequence: Synthetic primer"
gggctggcaagccacgtttggtggctccagggaaggggctggagtga

SEQ ID NO: 5269 - DNA, 47 bp, Artificial Sequence
  source: /note="Description of Artificial Sequence: Synthetic primer"
gggctggcaagccacgtttggtggctccagggaagggtctgcagtgg

SEQ ID NO: 5270 - DNA, 47 bp, Artificial Sequence
  source: /note="Description of Artificial Sequence: Synthetic primer"
gggctggcaagccacgtttggtggctctcagggaggggctgcaatgg

SEQ ID NO: 5271 - DNA, 47 bp, Artificial Sequence
  source: /note="Description of Artificial Sequence: Synthetic primer"
gggctggcaagccacgtttggtggctggaggagaggggctggagtgg

SEQ ID NO: 5272 - DNA, 47 bp, Artificial Sequence
  source: /note="Description of Artificial Sequence: Synthetic primer"
gggctggcaagccacgtttggtggcttccgggaaagggctggagtgg

SEQ ID NO: 5273 - DNA, 48 bp, Artificial Sequence
  source: /note="Description of Artificial Sequence: Synthetic primer"
gggctggcaagccacgtttggtgggccactggacaagggcttgagtgg

SEQ ID NO: 5274 - DNA, 48 bp, Artificial Sequence
  source: /note="Description of Artificial Sequence: Synthetic primer"
gggctggcaagccacgtttggtgggcccatgcacaagggcttgagtgg

SEQ ID NO: 5275 - DNA, 48 bp, Artificial Sequence
  source: /note="Description of Artificial Sequence: Synthetic primer"
gggctggcaagccacgtttggtgggcccctggaaaagggcttgagtgg

SEQ ID NO: 5276 - DNA, 48 bp, Artificial Sequence
  source: /note="Description of Artificial Sequence: Synthetic primer"
gggctggcaagccacgtttggtgggcccctggacaagggcttgaaagg

SEQ ID NO: 5277 - DNA, 48 bp, Artificial Sequence
  source: /note="Description of Artificial Sequence: Synthetic primer"
gggctggcaagccacgtttggtgggctccagggaagggtctggagtgg

SEQ ID NO: 5278 - DNA, 48 bp, Artificial Sequence
  source: /note="Description of Artificial Sequence: Synthetic primer"
gggctggcaagccacgtttggtgggctcgtggacaacgccttgagtgg

SEQ ID NO: 5279 - DNA, 47 bp, Artificial Sequence
  source: /note="Description of Artificial Sequence: Synthetic primer"
gggctggcaagccacgtttggtggggccctggacaagggcatagtgg

SEQ ID NO: 5280 - DNA, 56 bp, Artificial Sequence
  source: /note="Description of Artificial Sequence: Synthetic primer"
gggctggcaagccacgtttggtggtccagcaggattcatggcaagtgttggtgagg

SEQ ID NO: 5281 - DNA, 56 bp, Artificial Sequence
  source: /note="Description of Artificial Sequence: Synthetic primer"
gggctggcaagccacgtttggtggtgtgacaggcccctggataagggtttgaatgg

SEQ ID NO: 5282 - DNA, 55 bp, Artificial Sequence
  source: /note="Description of Artificial Sequence: Synthetic primer"
gggctggcaagccacgtttggtgtccagcaggcttcatgacagggatttgtgtgg

SEQ ID NO: 5283 - DNA, 45 bp, Artificial Sequence
  source: /note="Description of Artificial Sequence: Synthetic primer"
gggctggcaagccacgtttggtgtcccgggaaggggctggaatgg

SEQ ID NO: 5284 - DNA, 47 bp, Artificial Sequence
  source: /note="Description of Artificial Sequence: Synthetic primer"
gggctggcaagccacgtttggtgtctccaggcaaggggctggagtga

SEQ ID NO: 5285 - DNA, 53 bp, Artificial Sequence
  source: /note="Description of Artificial Sequence: Synthetic primer"
gggctggcaagccacgtttggtgtgatagacccctggacagggctttgagtgg

SEQ ID NO: 5286 - DNA, 54 bp, Artificial Sequence
  source: /note="Description of Artificial Sequence: Synthetic primer"
gggctggcaagccacgtttggtgtgtgacaaagccctggacaagggcatagtgg

SEQ ID NO: 5287 - DNA, 48 bp, Artificial Sequence
  source: /note="Description of Artificial Sequence: Synthetic primer"
ccgggagctgcatgtgtcagaggcacctgaggagacggtgaccagggt

SEQ ID NO: 5288 - DNA, 51 bp, Artificial Sequence
  source: /note="Description of Artificial Sequence: Synthetic primer"
ccgggagctgcatgtgtcagaggactcacctgaggagacagtgaccagggt

SEQ ID NO: 5289 - DNA, 60 bp, Artificial Sequence
  source: /note="Description of Artificial Sequence: Synthetic primer"
ccgggagctgcatgtgtcagaggggaaagccatcttacctgaagagacggtgaccattgt

SEQ ID NO: 5290 - DNA, 51 bp, Artificial Sequence
  source: /note="Description of Artificial Sequence: Synthetic primer"
ccgggagctgcatgtgtcagaggtcttacctgaggagacggtgaccgtggt

SEQ ID NO: 5291 - DNA, 43 bp, Artificial Sequence
  source: /note="Description of Artificial Sequence: Synthetic primer"
ccgggagctgcatgtgtcagagggtggctgcggtctccagggc

SEQ ID NO: 5292 - DNA, 41 bp, Artificial Sequence
  source: /note="Description of Artificial Sequence: Synthetic primer"
ccgggagctgcatgtgtcagaggggagacggtggccgggct

SEQ ID NO: 5293 - DNA, 47 bp, Artificial Sequence
  source: /note="Description of Artificial Sequence: Synthetic primer"
ccgggagctgcatgtgtcagagggcctgacccctcagaagccagacc

SEQ ID NO: 5294 - DNA, 26 bp, Artificial Sequence
  source: /note="Description of Artificial Sequence: Synthetic oligonucleotide"
agcccccagggaagaagctgaagtgg

SEQ ID NO: 5295 - DNA, 26 bp, Artificial Sequence
  source: /note="Description of Artificial Sequence: Synthetic oligonucleotide"
aggctccagggaatgggctggagttg

SEQ ID NO: 5296 - DNA, 26 bp, Artificial Sequence
  source: /note="Description of Artificial Sequence: Synthetic oligonucleotide"
aggcttcaggacaggggttggtgtgg

SEQ ID NO: 5297 - DNA, 26 bp, Artificial Sequence
  source: /note="Description of Artificial Sequence: Synthetic oligonucleotide"
aggcttcatgacaggggtgggtgtgg

SEQ ID NO: 5298 - DNA, 27 bp, Artificial Sequence
  source: /note="Description of Artificial Sequence: Synthetic oligonucleotide"
caagctccagggaagggactggagtgg

SEQ ID NO: 5299 - DNA, 31 bp, Artificial Sequence
  source: /note="Description of Artificial Sequence: Synthetic oligonucleotide"
caatgagactctagggaaggggctggaggga

SEQ ID NO: 5300 - DNA, 23 bp, Artificial Sequence
  source: /note="Description of Artificial Sequence: Synthetic oligonucleotide"
caccagggaagggcctggagtgg

SEQ ID NO: 5301 - DNA, 30 bp, Artificial Sequence
  source: /note="Description of Artificial Sequence: Synthetic oligonucleotide"
cacgagtccacatgggaaggactggagtgg

SEQ ID NO: 5302 - DNA, 30 bp, Artificial Sequence
  source: /note="Description of Artificial Sequence: Synthetic oligonucleotide"
cagcaggcttcatgacagggattggtgtgg

SEQ ID NO: 5303 - DNA, 24 bp, Artificial Sequence
  source: /note="Description of Artificial Sequence: Synthetic oligonucleotide"
cactagcccgcttccatgggctgt

SEQ ID NO: 5304 - DNA, 30 bp, Artificial Sequence
  source: /note="Description of Artificial Sequence: Synthetic oligonucleotide"
cagcaggcttcacaacagggattgtggtgg

SEQ ID NO: 5305 - DNA, 30 bp, Artificial Sequence; identical to SEQ ID NO: 5302
  source: /note="Description of Artificial Sequence: Synthetic oligonucleotide"

SEQ ID NO: 5306 - DNA, 27 bp, Artificial Sequence
  source: /note="Description of Artificial Sequence: Synthetic oligonucleotide"
caggcccatggacaagggcttgaggaa

SEQ ID NO: 5307 - DNA, 27 bp, Artificial Sequence
  source: /note="Description of Artificial Sequence: Synthetic oligonucleotide"
caggctccagggaacagactggagtgg

SEQ ID NO: 5308 - DNA, 27 bp, Artificial Sequence
  source: /note="Description of Artificial Sequence: Synthetic oligonucleotide"
caggcttctgggaaagggctggagtgg

SEQ ID NO: 5309 - DNA, 27 bp, Artificial Sequence
  source: /note="Description of Artificial Sequence: Synthetic oligonucleotide"
cagtccccatcgagaggccttgagtgg

SEQ ID NO: 5310 - DNA, 27 bp, Artificial Sequence
  source: /note="Description of Artificial Sequence: Synthetic oligonucleotide"
cagtcccctggacaagggcttgagtgg

SEQ ID NO: 5311 - DNA, 30 bp, Artificial Sequence
  source: /note="Description of Artificial Sequence: Synthetic oligonucleotide"
catcaggctcctgggaaagggctggagtag

SEQ ID NO: 5312 - DNA, 28 bp, Artificial Sequence
  source: /note="Description of Artificial Sequence: Synthetic oligonucleotide"
ccagatgcccgggaaagaactggagtgg

SEQ ID NO: 5313 - DNA, 31 bp, Artificial Sequence
  source: /note="Description of Artificial Sequence: Synthetic oligonucleotide"
ccagcacgcttcacaacaggaattggtgtgg

SEQ ID NO: 5314 - DNA, 31 bp, Artificial Sequence
  source: /note="Description of Artificial Sequence: Synthetic oligonucleotide"
ccagcacgcttcacaacagggataggtgtgg

SEQ ID NO: 5315 - DNA, 28 bp, Artificial Sequence
  source: /note="Description of Artificial Sequence: Synthetic oligonucleotide"
ccaggctccaggaaagggtttggagtgg

SEQ ID NO: 5316 - DNA, 22 bp, Artificial Sequence
  source: /note="Description of Artificial Sequence: Synthetic oligonucleotide"
cccagggaaggccctggagtgg

SEQ ID NO: 5317 - DNA, 22 bp, Artificial Sequence
  source: /note="Description of Artificial Sequence: Synthetic oligonucleotide"
cccagggaaggggctggagtgg

SEQ ID NO: 5318 - DNA, 23 bp, Artificial Sequence
  source: /note="Description of Artificial Sequence: Synthetic oligonucleotide"
ccccaggaaaggccctggagtgg

SEQ ID NO: 5319 - DNA, 23 bp, Artificial Sequence
  source: /note="Description of Artificial Sequence: Synthetic oligonucleotide"
ccccaggacaggggcttgagtgg

SEQ ID NO: 5320 - DNA, 23 bp, Artificial Sequence
  source: /note="Description of Artificial Sequence: Synthetic oligonucleotide"
ccccagggaagggactggagtgg

SEQ ID NO: 5321 - DNA, 23 bp, Artificial Sequence
  source: /note="Description of Artificial Sequence: Synthetic oligonucleotide"
ccccagggaaggggctggaatgg

SEQ ID NO: 5322 - DNA, 24 bp, Artificial Sequence
  source: /note="Description of Artificial Sequence: Synthetic oligonucleotide"
cccccagggaagggaatggagtgg

SEQ ID NO: 5323 - DNA, 24 bp, Artificial Sequence
  source: /note="Description of Artificial Sequence: Synthetic oligonucleotide"
ccccccaggaagggactggagtga

SEQ ID NO: 5324 - DNA, 23 bp, Artificial Sequence
  source: /note="Description of Artificial Sequence: Synthetic oligonucleotide"
cccccggacaagcgcttgagtgg

SEQ ID NO: 5325 - DNA, 26 bp, Artificial Sequence
  source: /note="Description of Artificial Sequence: Synthetic oligonucleotide"
cccctctctgggagggaatggagtgg

SEQ ID NO: 5326 - DNA, 24 bp, Artificial Sequence
  source: /note="Description of Artificial Sequence: Synthetic oligonucleotide"
cccgtgggcaacaggctggaatgg

SEQ ID NO: 5327 - DNA, 24 bp, Artificial Sequence
  source: /note="Description of Artificial Sequence: Synthetic oligonucleotide"
ccctcagcaaaggccctggagtgg

SEQ ID NO: 5328 - DNA, 23 bp, Artificial Sequence
  source: /note="Description of Artificial Sequence: Synthetic oligonucleotide"
ccgcaaggaagggactggagcga

SEQ ID NO: 5329 - DNA, 31 bp, Artificial Sequence
  source: /note="Description of Artificial Sequence: Synthetic oligonucleotide"
ccgccaagctacaggaaaaggtctggagtgg

SEQ ID NO: 5330 - DNA, 26 bp, Artificial Sequence
  source: /note="Description of Artificial Sequence: Synthetic oligonucleotide"
ccgccagtcctcagtcaagggagtgg

SEQ ID NO: 5331 - DNA, 20 bp, Artificial Sequence
  source: /note="Description of Artificial Sequence: Synthetic oligonucleotide"
ccgggaaggggctggagtgg

SEQ ID NO: 5332 - DNA, 28 bp, Artificial Sequence
  source: /note="Description of Artificial Sequence: Synthetic oligonucleotide"
ccgggcttcaagaaaggggctggaatgg

SEQ ID NO: 5333 - DNA, 21 bp, Artificial Sequence
  source: /note="Description of Artificial Sequence: Synthetic oligonucleotide"
ccggggaagggactggagcga

SEQ ID NO: 5334 - DNA, 38 bp, Artificial Sequence
  source: /note="Description of Artificial Sequence: Synthetic oligonucleotide"
cctggatccaccatctcccatcaaaaggtcttcagtgt

SEQ ID NO: 5335 - DNA, 30 bp, Artificial Sequence
  source: /note="Description of Artificial Sequence: Synthetic oligonucleotide"
cgccaggctccaagaaagggtttgtagtgg

SEQ ID NO: 5336 - DNA, 22 bp, Artificial Sequence
  source: /note="Description of Artificial Sequence: Synthetic oligonucleotide"
cgccgggaagggactggagtgg

SEQ ID NO: 5337 - DNA, 23 bp, Artificial Sequence
  source: /note="Description of Artificial Sequence: Synthetic oligonucleotide"
ctccaggcaaggggctggagtgg

SEQ ID NO: 5338 - DNA, 23 bp, Artificial Sequence
  source: /note="Description of Artificial Sequence: Synthetic oligonucleotide"
ctccagggaagggcctggagtgg

SEQ ID NO: 5339 - DNA, 23 bp, Artificial Sequence
  source: /note="Description of Artificial Sequence: Synthetic oligonucleotide"
ctccagggaaggggctggagtgg

SEQ ID NO: 5340 - DNA, 23 bp, Artificial Sequence
  source: /note="Description of Artificial Sequence: Synthetic oligonucleotide"
ctccagggaaggggctggtgtgg

SEQ ID NO: 5341 - DNA, 23 bp, Artificial Sequence
  source: /note="Description of Artificial Sequence: Synthetic oligonucleotide"
ctccagggaagggtccggagtgg

SEQ ID NO: 5342 - DNA, 25 bp, Artificial Sequence
  source: /note="Description of Artificial Sequence: Synthetic oligonucleotide"
ctccccagggaagggactggagtga

SEQ ID NO: 5343 - DNA, 23 bp, Artificial Sequence
  source: /note="Description of Artificial Sequence: Synthetic oligonucleotide"
ctccggagaaggggctggagtgg

SEQ ID NO: 5344 - DNA, 23 bp, Artificial Sequence
  source: /note="Description of Artificial Sequence: Synthetic oligonucleotide"
ctccggggaagggtctggagtgg

SEQ ID NO: 5345 - DNA, 23 bp, Artificial Sequence
  source: /note="Description of Artificial Sequence: Synthetic oligonucleotide"
ctgcaggcaaggggctggagtga

SEQ ID NO: 5346 - DNA, 31 bp, Artificial Sequence
  source: /note="Description of Artificial Sequence: Synthetic oligonucleotide"
ctgcttgcccctagaagatggacaggagtgg

SEQ ID NO: 5347 - DNA, 20 bp, Artificial Sequence
  source: /note="Description of Artificial Sequence: Synthetic oligonucleotide"
ctgggaaggcgctggggcac

SEQ ID NO: 5348 - DNA, 23 bp, Artificial Sequence
  source: /note="Description of Artificial Sequence: Synthetic oligonucleotide"
ctgggggacagaggctggagtgg

SEQ ID NO: 5349 - DNA, 32 bp, Artificial Sequence
  source: /note="Description of Artificial Sequence: Synthetic oligonucleotide"
ctgtaggcactggatggaaagcacaggagtgg

SEQ ID NO: 5350 - DNA, 29 bp, Artificial Sequence
  source: /note="Description of Artificial Sequence: Synthetic oligonucleotide"
gacaggctcctggaaaagggcttgagtgg

SEQ ID NO: 5351 - DNA, 29 bp, Artificial Sequence
  source: /note="Description of Artificial Sequence: Synthetic oligonucleotide"
gatccgccagtcctcagtcaagggagtgg

SEQ ID NO: 5352 - DNA, 25 bp, Artificial Sequence
  source: /note="Description of Artificial Sequence: Synthetic oligonucleotide"
gatgcccgggaaaggcttggagtgg

SEQ ID NO: 5353 - DNA, 28 bp, Artificial Sequence
  source: /note="Description of Artificial Sequence: Synthetic oligonucleotide"
gcaggcttcatgacaggggtgggtgtag

SEQ ID NO: 5354 - DNA, 29 bp, Artificial Sequence
  source: /note="Description of Artificial Sequence: Synthetic oligonucleotide"
gccaggctccagggaagggactggaatat

SEQ ID NO: 5355 - DNA, 25 bp, Artificial Sequence
  source: /note="Description of Artificial Sequence: Synthetic oligonucleotide"
gcccccatgggaggtactggagtgg

SEQ ID NO: 5356 - DNA, 24 bp, Artificial Sequence
  source: /note="Description of Artificial Sequence: Synthetic oligonucleotide"
gcccccggacaaaggcttgagtgg

SEQ ID NO: 5357 - DNA, 24 bp, Artificial Sequence
  source: /note="Description of Artificial Sequence: Synthetic oligonucleotide"
gcccctggacaagggcttgagtgg

SEQ ID NO: 5358 - DNA, 22 bp, Artificial Sequence
  source: /note="Description of Artificial Sequence: Synthetic oligonucleotide"
gcccgggaaaggcctggagtgg

SEQ ID NO: 5359 - DNA, 24 bp, Artificial Sequence
  source: /note="Description of Artificial Sequence: Synthetic oligonucleotide"
gcctcagggaaggggctggaatgg

SEQ ID NO: 5360 - DNA, 24 bp, Artificial Sequence
  source: /note="Description of Artificial Sequence: Synthetic oligonucleotide"
gctccaggaaaggggctgcagtga

SEQ ID NO: 5361 - DNA, 24 bp, Artificial Sequence
  source: /note="Description of Artificial Sequence: Synthetic oligonucleotide"
gctccaggaaaggggctggagtgg

SEQ ID NO: 5362 - DNA, 24 bp, Artificial Sequence
  source: /note="Description of Artificial Sequence: Synthetic oligonucleotide"
gctccagggaagggtctgcagtgg

SEQ ID NO: 5363 - DNA, 24 bp, Artificial Sequence
  source: /note="Description of Artificial Sequence: Synthetic oligonucleotide"
gctctcagggaggggctgcaatgg

SEQ ID NO: 5364 - DNA, 24 bp, Artificial Sequence
  source: /note="Description of Artificial Sequence: Synthetic oligonucleotide"
gctggaggagaggggctggagtgg

SEQ ID NO: 5365 - DNA, 24 bp, Artificial Sequence
  source: /note="Description of Artificial Sequence: Synthetic oligonucleotide"
gcttccgggaaagggctggagtgg

SEQ ID NO: 5366 - DNA, 25 bp, Artificial Sequence
  source: /note="Description of Artificial Sequence: Synthetic oligonucleotide"
ggccactggacaagggcttgagtgg

SEQ ID NO: 5367 - DNA, 25 bp, Artificial Sequence
  source: /note="Description of Artificial Sequence: Synthetic oligonucleotide"
ggcccatgcacaagggcttgagtgg

SEQ ID NO: 5368 - DNA, 25 bp, Artificial Sequence
  source: /note="Description of Artificial Sequence: Synthetic oligonucleotide"
ggcccctggaaaagggcttgagtgg

SEQ ID NO: 5369 - DNA, 25 bp, Artificial Sequence
  source: /note="Description of Artificial Sequence: Synthetic oligonucleotide"
ggcccctggacaagggcttgaaagg

SEQ ID NO: 5370 - DNA, 25 bp, Artificial Sequence
  source: /note="Description of Artificial Sequence: Synthetic oligonucleotide"
ggctccagggaagggtctggagtgg

SEQ ID NO: 5371 - DNA, 25 bp, Artificial Sequence
  source: /note="Description of Artificial Sequence: Synthetic oligonucleotide"
ggctcgtggacaacgccttgagtgg

SEQ ID NO: 5372 - DNA, 24 bp, Artificial Sequence
  source: /note="Description of Artificial Sequence: Synthetic oligonucleotide"
gggccctggacaagggcatagtgg

SEQ ID NO: 5373 - DNA, 33 bp, Artificial Sequence
  source: /note="Description of Artificial Sequence: Synthetic oligonucleotide"
gtccagcaggattcatggcaagtgttggtgagg

SEQ ID NO: 5374 - DNA, 33 bp, Artificial Sequence
  source: /note="Description of Artificial Sequence: Synthetic oligonucleotide"
gtgtgacaggcccctggataagggtttgaatgg

SEQ ID NO: 5375 - DNA, 32 bp, Artificial Sequence
  source: /note="Description of Artificial Sequence: Synthetic oligonucleotide"
tccagcaggcttcatgacagggatttgtgtgg

SEQ ID NO: 5376 - DNA, 22 bp, Artificial Sequence
  source: /note="Description of Artificial Sequence: Synthetic oligonucleotide"
tcccgggaaggggctggaatgg

SEQ ID NO: 5377 - DNA, 24 bp, Artificial Sequence
  source: /note="Description of Artificial Sequence: Synthetic oligonucleotide"
tctccaggcaaggggctggagtga

SEQ ID NO: 5378 - DNA, 30 bp, Artificial Sequence
  source: /note="Description of Artificial Sequence: Synthetic oligonucleotide"
tgatagacccctggacagggctttgagtgg

SEQ ID NO: 5379 - DNA, 31 bp, Artificial Sequence
  source: /note="Description of Artificial Sequence: Synthetic oligonucleotide"
tgtgacaaagccctggacaagggcatagtgg

SEQ ID NO: 5380 - DNA, 25 bp, Artificial Sequence
  source: /note="Description of Artificial Sequence: Synthetic oligonucleotide"
cacctgaggagacggtgaccagggt

SEQ ID NO: 5381 - DNA, 28 bp, Artificial Sequence
  source: /note="Description of Artificial Sequence: Synthetic oligonucleotide"
actcacctgaggagacagtgaccagggt

SEQ ID NO: 5382 - DNA, 37 bp, Artificial Sequence
  source: /note="Description of Artificial Sequence: Synthetic oligonucleotide"
ggaaagccatcttacctgaagagacggtgaccattgt

SEQ ID NO: 5383 - DNA, 28 bp, Artificial Sequence
  source: /note="Description of Artificial Sequence: Synthetic oligonucleotide"
tcttacctgaggagacggtgaccgtggt

SEQ ID NO: 5384 - DNA, 20 bp, Artificial Sequence
  source: /note="Description of Artificial Sequence: Synthetic oligonucleotide"
gtggctgcggtctccagggc

SEQ ID NO: 5385 - DNA, 18 bp, Artificial Sequence
  source: /note="Description of Artificial Sequence: Synthetic oligonucleotide"
ggagacggtggccgggct

SEQ ID NO: 5386 - DNA, 24 bp, Artificial Sequence
  source: /note="Description of Artificial Sequence: Synthetic oligonucleotide"
gcctgacccctcagaagccagacc

SEQ ID NO: 5387 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnncaaggtcaccgggagctgcatgtgtcagagg

SEQ ID NO: 5388 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnngcataactccgggagctgcatgtgtcagagg

SEQ ID NO: 5389 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnctctgattccgggagctgcatgtgtcagagg

SEQ ID NO: 5390 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnntacgtacgccgggagctgcatgtgtcagagg

SEQ ID NO: 5391 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnntacgcgttccgggagctgcatgtgtcagagg

SEQ ID NO: 5392 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnctcagtgaccgggagctgcatgtgtcagagg

SEQ ID NO: 5393 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnntctgatatccgggagctgcatgtgtcagagg

SEQ ID NO: 5394 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnncatatgctccgggagctgcatgtgtcagagg

SEQ ID NO: 5395 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnncgtaattaccgggagctgcatgtgtcagagg

SEQ ID NO: 5396 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnacgtactcccgggagctgcatgtgtcagagg

SEQ ID NO: 5397 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnncttctaagccgggagctgcatgtgtcagagg

SEQ ID NO: 5398 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnactatgacccgggagctgcatgtgtcagagg

SEQ ID NO: 5399 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnngacgttaaccgggagctgcatgtgtcagagg

SEQ ID NO: 5400 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnacaagataccgggagctgcatgtgtcagagg

SEQ ID NO: 5401 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnngactaagaccgggagctgcatgtgtcagagg

SEQ ID NO: 5402 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnngtgtctacccgggagctgcatgtgtcagagg

SEQ ID NO: 5403 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnttcactagccgggagctgcatgtgtcagagg

SEQ ID NO: 5404 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnaatcggatccgggagctgcatgtgtcagagg

SEQ ID NO: 5405 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnagtaccgaccgggagctgcatgtgtcagagg

SEQ ID NO: 5406 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnttgcctcaccgggagctgcatgtgtcagagg

SEQ ID NO: 5407 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnntcgttagcccgggagctgcatgtgtcagagg

SEQ ID NO: 5408 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnntatagttcccgggagctgcatgtgtcagagg

SEQ ID NO: 5409 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnntggcgtatccgggagctgcatgtgtcagagg

SEQ ID NO: 5410 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnntggacatgccgggagctgcatgtgtcagagg

SEQ ID NO: 5411 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnaggttgctccgggagctgcatgtgtcagagg

SEQ ID NO: 5412 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnatatgctgccgggagctgcatgtgtcagagg

SEQ ID NO: 5413 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnngtacagtgccgggagctgcatgtgtcagagg

SEQ ID NO: 5414 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnatccatggccgggagctgcatgtgtcagagg

SEQ ID NO: 5415 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnntgatgcgaccgggagctgcatgtgtcagagg

SEQ ID NO: 5416 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnngtagcagtccgggagctgcatgtgtcagagg

SEQ ID NO: 5417 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnggatcatcccgggagctgcatgtgtcagagg

SEQ ID NO: 5418 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnngtgaacgtccgggagctgcatgtgtcagagg

SEQ ID NO: 5419 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnattaagcgccgggagctgcatgtgtcagagg

SEQ ID NO: 5420 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnntattggcgccgggagctgcatgtgtcagagg

SEQ ID NO: 5421 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnncgattacaccgggagctgcatgtgtcagagg

SEQ ID NO: 5422 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnntgtcatcgccgggagctgcatgtgtcagagg

SEQ ID NO: 5423 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnntatcaagtccgggagctgcatgtgtcagagg

SEQ ID NO: 5424 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnaggcttgaccgggagctgcatgtgtcagagg

SEQ ID NO: 5425 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnngataaccaccgggagctgcatgtgtcagagg

SEQ ID NO: 5426 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnaatcctgcccgggagctgcatgtgtcagagg

SEQ ID NO: 5427 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnngttatatcccgggagctgcatgtgtcagagg

SEQ ID NO: 5428 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnacacacgtccgggagctgcatgtgtcagagg

SEQ ID NO: 5429 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnatacgactccgggagctgcatgtgtcagagg

SEQ ID NO: 5430 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnatcttcgtccgggagctgcatgtgtcagagg

SEQ ID NO: 5431 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnacatgtatccgggagctgcatgtgtcagagg

SEQ ID NO: 5432 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnntccacagtccgggagctgcatgtgtcagagg

SEQ ID NO: 5433 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnncagtctgtccgggagctgcatgtgtcagagg

SEQ ID NO: 5434 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnntccatgtgccgggagctgcatgtgtcagagg

SEQ ID NO: 5435 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnntcactgcaccgggagctgcatgtgtcagagg

SEQ ID NO: 5436 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnatggtcaaccgggagctgcatgtgtcagagg

SEQ ID NO: 5437 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnncaagtcacccgggagctgcatgtgtcagagg

SEQ ID NO: 5438 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnntagacggaccgggagctgcatgtgtcagagg

SEQ ID NO: 5439 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnncagctcttccgggagctgcatgtgtcagagg

SEQ ID NO: 5440 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnngagcgataccgggagctgcatgtgtcagagg

SEQ ID NO: 5441 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnctcgagaaccgggagctgcatgtgtcagagg

SEQ ID NO: 5442 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnatgacaccccgggagctgcatgtgtcagagg

SEQ ID NO: 5443 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnncttcacgaccgggagctgcatgtgtcagagg

SEQ ID NO: 5444 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnctataaggccgggagctgcatgtgtcagagg

SEQ ID NO: 5445 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnncgtagagtccgggagctgcatgtgtcagagg

SEQ ID NO: 5446 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnatagatacccgggagctgcatgtgtcagagg

SEQ ID NO: 5447 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnntcgtcgatccgggagctgcatgtgtcagagg

SEQ ID NO: 5448 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnntaagaatcccgggagctgcatgtgtcagagg

SEQ ID NO: 5449 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnaatgacagccgggagctgcatgtgtcagagg

SEQ ID NO: 5450 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnagctagtgccgggagctgcatgtgtcagagg

SEQ ID NO: 5451 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnntgagacctccgggagctgcatgtgtcagagg

SEQ ID NO: 5452 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnagcgtaatccgggagctgcatgtgtcagagg

SEQ ID NO: 5453 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnntaaccaagccgggagctgcatgtgtcagagg

SEQ ID NO: 5454 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnngatggcttccgggagctgcatgtgtcagagg

SEQ ID NO: 5455 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnngcatctgaccgggagctgcatgtgtcagagg

SEQ ID NO: 5456 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnttccggtaccgggagctgcatgtgtcagagg

SEQ ID NO: 5457 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnngacactctccgggagctgcatgtgtcagagg

SEQ ID NO: 5458 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnttaagcatccgggagctgcatgtgtcagagg

SEQ ID NO: 5459 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnntgctacacccgggagctgcatgtgtcagagg

SEQ ID NO: 5460 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnntcagcttgccgggagctgcatgtgtcagagg

SEQ ID NO: 5461 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnncatgtagaccgggagctgcatgtgtcagagg

SEQ ID NO: 5462 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnttcggaacccgggagctgcatgtgtcagagg

SEQ ID NO: 5463 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnngcaattcgccgggagctgcatgtgtcagagg

SEQ ID NO: 5464 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnncaagaggtccgggagctgcatgtgtcagagg

SEQ ID NO: 5465 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnntcgattaaccgggagctgcatgtgtcagagg

SEQ ID NO: 5466 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnngaatggacccgggagctgcatgtgtcagagg

SEQ ID NO: 5467 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnagaatcagccgggagctgcatgtgtcagagg

SEQ ID NO: 5468 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnaactgccaccgggagctgcatgtgtcagagg

SEQ ID NO: 5469 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnaagtaacgccgggagctgcatgtgtcagagg

SEQ ID NO: 5470 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnactcaatgccgggagctgcatgtgtcagagg

SEQ ID NO: 5471 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnncctagtagccgggagctgcatgtgtcagagg

SEQ ID NO: 5472 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnctgacgttccgggagctgcatgtgtcagagg

SEQ ID NO: 5473 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnntgcagacaccgggagctgcatgtgtcagagg

SEQ ID NO: 5474 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnagttgaccccgggagctgcatgtgtcagagg

SEQ ID NO: 5475 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnngtctcctaccgggagctgcatgtgtcagagg

SEQ ID NO: 5476 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnctgcaatcccgggagctgcatgtgtcagagg

SEQ ID NO: 5477 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnntgagcgaaccgggagctgcatgtgtcagagg

SEQ ID NO: 5478 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnttggactgccgggagctgcatgtgtcagagg

SEQ ID NO: 5479 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnagcaatccccgggagctgcatgtgtcagagg

SEQ ID NO: 5480 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnncgaactacccgggagctgcatgtgtcagagg

SEQ ID NO: 5481 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnnttaatggcccgggagctgcatgtgtcagagg

SEQ ID NO: 5482 - DNA, 103 bp, Artificial Sequence
  source: /note="Description of Artificial Sequence: Synthetic primer"
  modified_base (67)..(72): a, c, t or g
aatgatacggcgaccaccgagatctacaccggtctcggcattcctgctgaaccgctcttccgatctnnnnnngcttagtaccgggagctgcatgtgtcagagg

SEQ ID NO: 5483 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctcaaggtcannnnnngggctggcaagccacgtttggtg

SEQ ID NO: 5484 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctgcataactnnnnnngggctggcaagccacgtttggtg

SEQ ID NO: 5485 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctctctgattnnnnnngggctggcaagccacgtttggtg

SEQ ID NO: 5486 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatcttacgtacgnnnnnngggctggcaagccacgtttggtg

SEQ ID NO: 5487 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatcttacgcgttnnnnnngggctggcaagccacgtttggtg

SEQ ID NO: 5488 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctctcagtgannnnnngggctggcaagccacgtttggtg

SEQ ID NO: 5489 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatcttctgatatnnnnnngggctggcaagccacgtttggtg

SEQ ID NO: 5490 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctcatatgctnnnnnngggctggcaagccacgtttggtg

SEQ ID NO: 5491 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctcgtaattannnnnngggctggcaagccacgtttggtg

SEQ ID NO: 5492 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctacgtactcnnnnnngggctggcaagccacgtttggtg

SEQ ID NO: 5493 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctcttctaagnnnnnngggctggcaagccacgtttggtg

SEQ ID NO: 5494 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctactatgacnnnnnngggctggcaagccacgtttggtg

SEQ ID NO: 5495 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctgacgttaannnnnngggctggcaagccacgtttggtg

SEQ ID NO: 5496 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctacaagatannnnnngggctggcaagccacgtttggtg

SEQ ID NO: 5497 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctgactaagannnnnngggctggcaagccacgtttggtg

SEQ ID NO: 5498 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctgtgtctacnnnnnngggctggcaagccacgtttggtg

SEQ ID NO: 5499 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctttcactagnnnnnngggctggcaagccacgtttggtg

SEQ ID NO: 5500 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctaatcggatnnnnnngggctggcaagccacgtttggtg

SEQ ID NO: 5501 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctagtaccgannnnnngggctggcaagccacgtttggtg

SEQ ID NO: 5502 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctttgcctcannnnnngggctggcaagccacgtttggtg

SEQ ID NO: 5503 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatcttcgttagcnnnnnngggctggcaagccacgtttggtg

SEQ ID NO: 5504 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatcttatagttcnnnnnngggctggcaagccacgtttggtg

SEQ ID NO: 5505 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatcttggcgtatnnnnnngggctggcaagccacgtttggtg

SEQ ID NO: 5506 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatcttggacatgnnnnnngggctggcaagccacgtttggtg

SEQ ID NO: 5507 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctaggttgctnnnnnngggctggcaagccacgtttggtg

SEQ ID NO: 5508 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctatatgctgnnnnnngggctggcaagccacgtttggtg

SEQ ID NO: 5509 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctgtacagtgnnnnnngggctggcaagccacgtttggtg

SEQ ID NO: 5510 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctatccatggnnnnnngggctggcaagccacgtttggtg

SEQ ID NO: 5511 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatcttgatgcgannnnnngggctggcaagccacgtttggtg

SEQ ID NO: 5512 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctgtagcagtnnnnnngggctggcaagccacgtttggtg

SEQ ID NO: 5513 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctggatcatcnnnnnngggctggcaagccacgtttggtg

SEQ ID NO: 5514 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctgtgaacgtnnnnnngggctggcaagccacgtttggtg

SEQ ID NO: 5515 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctattaagcgnnnnnngggctggcaagccacgtttggtg

SEQ ID NO: 5516 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatcttattggcgnnnnnngggctggcaagccacgtttggtg

SEQ ID NO: 5517 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctcgattacannnnnngggctggcaagccacgtttggtg

SEQ ID NO: 5518 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatcttgtcatcgnnnnnngggctggcaagccacgtttggtg

SEQ ID NO: 5519 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatcttatcaagtnnnnnngggctggcaagccacgtttggtg

SEQ ID NO: 5520 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctaggcttgannnnnngggctggcaagccacgtttggtg

SEQ ID NO: 5521 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctgataaccannnnnngggctggcaagccacgtttggtg

SEQ ID NO: 5522 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctaatcctgcnnnnnngggctggcaagccacgtttggtg

SEQ ID NO: 5523 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctgttatatcnnnnnngggctggcaagccacgtttggtg

SEQ ID NO: 5524 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctacacacgtnnnnnngggctggcaagccacgtttggtg

SEQ ID NO: 5525 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctatacgactnnnnnngggctggcaagccacgtttggtg

SEQ ID NO: 5526 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctatcttcgtnnnnnngggctggcaagccacgtttggtg

SEQ ID NO: 5527 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctacatgtatnnnnnngggctggcaagccacgtttggtg

SEQ ID NO: 5528 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatcttccacagtnnnnnngggctggcaagccacgtttggtg

SEQ ID NO: 5529 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctcagtctgtnnnnnngggctggcaagccacgtttggtg

SEQ ID NO: 5530 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatcttccatgtgnnnnnngggctggcaagccacgtttggtg

SEQ ID NO: 5531 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatcttcactgcannnnnngggctggcaagccacgtttggtg

SEQ ID NO: 5532 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctatggtcaannnnnngggctggcaagccacgtttggtg

SEQ ID NO: 5533 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctcaagtcacnnnnnngggctggcaagccacgtttggtg

SEQ ID NO: 5534 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatcttagacggannnnnngggctggcaagccacgtttggtg

SEQ ID NO: 5535 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctcagctcttnnnnnngggctggcaagccacgtttggtg

SEQ ID NO: 5536 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctgagcgatannnnnngggctggcaagccacgtttggtg

SEQ ID NO: 5537 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctctcgagaannnnnngggctggcaagccacgtttggtg

SEQ ID NO: 5538 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctatgacaccnnnnnngggctggcaagccacgtttggtg

SEQ ID NO: 5539 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctcttcacgannnnnngggctggcaagccacgtttggtg

SEQ ID NO: 5540 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctctataaggnnnnnngggctggcaagccacgtttggtg

SEQ ID NO: 5541 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctcgtagagtnnnnnngggctggcaagccacgtttggtg

SEQ ID NO: 5542 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctatagatacnnnnnngggctggcaagccacgtttggtg

SEQ ID NO: 5543 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatcttcgtcgatnnnnnngggctggcaagccacgtttggtg

SEQ ID NO: 5544 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatcttaagaatcnnnnnngggctggcaagccacgtttggtg

SEQ ID NO: 5545 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctaatgacagnnnnnngggctggcaagccacgtttggtg

SEQ ID NO: 5546 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctagctagtgnnnnnngggctggcaagccacgtttggtg

SEQ ID NO: 5547 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatcttgagacctnnnnnngggctggcaagccacgtttggtg

SEQ ID NO: 5548 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctagcgtaatnnnnnngggctggcaagccacgtttggtg

SEQ ID NO: 5549 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatcttaaccaagnnnnnngggctggcaagccacgtttggtg

SEQ ID NO: 5550 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctgatggcttnnnnnngggctggcaagccacgtttggtg

SEQ ID NO: 5551 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctgcatctgannnnnngggctggcaagccacgtttggtg

SEQ ID NO: 5552 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctttccggtannnnnngggctggcaagccacgtttggtg

SEQ ID NO: 5553 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctgacactctnnnnnngggctggcaagccacgtttggtg

SEQ ID NO: 5554 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctttaagcatnnnnnngggctggcaagccacgtttggtg

SEQ ID NO: 5555 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatcttgctacacnnnnnngggctggcaagccacgtttggtg

SEQ ID NO: 5556 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatcttcagcttgnnnnnngggctggcaagccacgtttggtg

SEQ ID NO: 5557 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctcatgtagannnnnngggctggcaagccacgtttggtg

SEQ ID NO: 5558 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctttcggaacnnnnnngggctggcaagccacgtttggtg

SEQ ID NO: 5559 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctgcaattcgnnnnnngggctggcaagccacgtttggtg

SEQ ID NO: 5560 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctcaagaggtnnnnnngggctggcaagccacgtttggtg

SEQ ID NO: 5561 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatcttcgattaannnnnngggctggcaagccacgtttggtg

SEQ ID NO: 5562 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctgaatggacnnnnnngggctggcaagccacgtttggtg

SEQ ID NO: 5563 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctagaatcagnnnnnngggctggcaagccacgtttggtg

SEQ ID NO: 5564 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctaactgccannnnnngggctggcaagccacgtttggtg

SEQ ID NO: 5565 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctaagtaacgnnnnnngggctggcaagccacgtttggtg

SEQ ID NO: 5566 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctactcaatgnnnnnngggctggcaagccacgtttggtg

SEQ ID NO: 5567 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctcctagtagnnnnnngggctggcaagccacgtttggtg

SEQ ID NO: 5568 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctctgacgttnnnnnngggctggcaagccacgtttggtg

SEQ ID NO: 5569 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatcttgcagacannnnnngggctggcaagccacgtttggtg

SEQ ID NO: 5570 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctagttgaccnnnnnngggctggcaagccacgtttggtg

SEQ ID NO: 5571 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctgtctcctannnnnngggctggcaagccacgtttggtg

SEQ ID NO: 5572 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctctgcaatcnnnnnngggctggcaagccacgtttggtg

SEQ ID NO: 5573 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatcttgagcgaannnnnngggctggcaagccacgtttggtg

SEQ ID NO: 5574 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctttggactgnnnnnngggctggcaagccacgtttggtg

SEQ ID NO: 5575 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctagcaatccnnnnnngggctggcaagccacgtttggtg

SEQ ID NO: 5576 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctcgaactacnnnnnngggctggcaagccacgtttggtg

SEQ ID NO: 5577 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctttaatggcnnnnnngggctggcaagccacgtttggtg

SEQ ID NO: 5578 - DNA, 94 bp, Artificial Sequence
  source: /note="Description of Artificial Sequence: Synthetic primer"
  modified_base (66)..(71): a, c, t or g
caagcagaagacggcatacgagatacactctttccctacacgacgctcttccgatctgcttagtannnnnngggctggcaagccacgtttggtg

SEQ ID NO: 5579 - DNA, 382 bp, Artificial Sequence
  source: /note="Description of Artificial Sequence: Synthetic polynucleotide"
gccttgccagcccgctcaggacactctgtacagtggccccggtctctgtgggtgttccgctaactggggctcccagtgctcaccccacaactaaagcgagccccagcctccagagcccccgaaggagatgccgcccacaagcccagcccccatccaggaggccccagagctcagggcgccggggcagattctgaacagccccgagtcacggtgggtacaactggagacactctgtacagtggtcgacatacttccagcactggggccagggcaccctggtcaccgtctcctcaggtgagtctgctgtctggggatagcggggagccaggtgtactgggccaggcaaggacactctgtacagtgctgatggcgcgagggaggc

SEQ ID NO: 5580 - DNA, 382 bp, Artificial Sequence
  source: /note="Description of Artificial Sequence: Synthetic polynucleotide"
gccttgccagcccgctcagttcggaacgtacagtgggcctcggtctctgtgggtgttccgctagctggggctcacagtgctcaccccacacctaaaacgagccacagcctcagagcccctgaaggagaccccgcccacaagcccagcccccacccaggaggccccagagcacagggcgccccgtcggattctgaacagccccgagtcacagtgggtataactggattcggaacgtacagtggtcgacatacttccagcactggggccagggcaccctggtcaccgtctcctcaggtgagtctgctgtctggggatagcggggagccaggtgtactgggccaggcaagttcggaacgtacagtgctgatggcgcgagggaggc

SEQ ID NO: 5581 - DNA, 382 bp, Artificial Sequence
  source: /note="Description of Artificial Sequence: Synthetic polynucleotide"
gccttgccagcccgctcagaagtaacggtacagtgggcctcggtctctgtgggtgttccgctagctggggctcacagtgctcaccccacacctaaaatgagccacagcctccggagcccccgcagagaccccgcccacaagcccagcccccacccaggaggccccagagctcagggcgccccgtcggattccgaacagccccgagtcacagcgggtataaccggaaagtaacggtacagtggtcgacatacttccagcactggggccagggcaccctggtcaccgtctcctcaggtgagtctgctgtctggggatagcggggagccaggtgtactgggccaggcaagaagtaacggtacagtgctgatggcgcgagggaggc

SEQ ID NO: 5582 - DNA, 382 bp, Artificial Sequence
  source: /note="Description of Artificial Sequence: Synthetic polynucleotide"
gccttgccagcccgctcaggtctcctagtacagtggtctctgtgggtgttccgctagctggggcccccagtgctcaccccacacctaaagcgagccccagcctccagagccccctaagcattccccgcccagcagcccagcccctgcccccacccaggaggccccagagctcagggcgcctggtcggattctgaacagccccgagtcacagtgggtataactggagtctcctagtacagtggtcgacatacttccagcactggggccagggcaccctggtcaccgtctcctcaggtgagtctgctgtctggggatagcggggagccaggtgtactgggccaggcaaggtctcctagtacagtgctgatggcgcgagggaggc

SEQ ID NO: 5583 - DNA, 385 bp, Artificial Sequence
  source: /note="Description of Artificial Sequence: Synthetic polynucleotide"
gccttgccagcccgctcagagagtgtcgtacagtgaggcctcaggctctgtgggtgccgctagctggggctgccagtcctcaccccacacctaaggtgagccacagccgccagagcctccacaggagaccccacccagcagcccagcccctacccaggaggccccagagctcagggcgcctgggtggattctgaacagccccgagtcacggtgggtatagtgggagctagagtgtcgtacagtggtcgacatacttccagcactggggccagggcaccctggtcaccgtctcctcaggtgagtctgctgtctggggatagcggggagccaggtgtactgggccaggcaagagagtgtcgtacagtgctgatggcgcgagggaggc

SEQ ID NO: 5584 - DNA, 396 bp, Artificial Sequence
  source: /note="Description of Artificial Sequence: Synthetic polynucleotide"
gccttgccagcccgctcaggttccgaagtacagtgaaaggaggagccccctgtacagcactgggctcagagtcctctcccacacaccctgagtttcagacaaaaaccccctggaaatcatagtatcagcaggagaactagccagagacagcaagaggggactcagtgactcccgcggggacaggaggattttgtgggggctcgtgtcactgtgaggatattgtagtagtaccagctgctgttccgaagtacagtggtcgacatacttccagcactggggccagggcaccctggtcaccgtctcctcaggtgagtctgctgtctggggatagcggggagccaggtgtactgggccaggcaaggttccgaagtacagtgctgatggcgcgagggaggc

SEQ ID NO: 5585 - DNA, 396 bp, Artificial Sequence
  source: /note="Description of Artificial Sequence: Synthetic polynucleotide"
gccttgccagcccgctcagcgttacttgtacagtgaaaggaggagccccttgttcagcactgggctcagagtcctctccaagacacccagagtttcagacaaaaaccccctggaatgcacagtctcagcaggagagccagccagagccagcaagatggggctcagtgacacccgcagggacaggaggattttgtgggggctcgtgtcactgtgaggatattgtactaatggtgtatgctcgttacttgtacagtggtcgacatacttccagcactggggccagggcaccctggtcaccgtctcctcaggtgagtctgctgtctggggatagcggggagccaggtgtactgggccaggcaagcgttacttgtacagtgctgatggcgcgagggaggc

SEQ ID NO: 5586 - DNA, 396 bp, Artificial Sequence
  source: /note="Description of Artificial Sequence: Synthetic polynucleotide"
gccttgccagcccgctcagtaggagacgtacagtgaaaggaggagccccctatacagcactgggctcagagtcctctctgagacaccctgagtttcagacaacaacccgctggaatgcacagtctcagcaggagaacagaccaaagccagcaaaagggacctcggtgacaccagtagggacaggaggattttgtgggggctcgtgtcactgtgaggatattgtagtggtggtagctgcttaggagacgtacagtggtcgacatacttccagcactggggccagggcaccctggtcaccgtctcctcaggtgagtctgctgtctggggatagcggggagccaggtgtactgggccaggcaagtaggagacgtacagtgctgatggcgcgagggaggc

SEQ ID NO: 5587 - DNA, 393 bp, Artificial Sequence
  source: /note="Description of Artificial Sequence: Synthetic polynucleotide"
gccttgccagcccgctcaggtgtctacgtacagtgagccccctgtacagcactgggctcagagtcctctctgagacaggctcagtttcagacaacaacccgctggaatgcacagtctcagcaggagagccaggccagagccagcaagaggagactcggtgacaccagtctcctgtagggacaggaggattttgtgggggttcgtgtcactgtgagcatattgtggtggtgactgctgtgtctacgtacagtggtcgacatacttccagcactggggccagggcaccctggtcaccgtctcctcaggtgagtctgctgtctggggatagcggggagccaggtgtactgggccaggcaaggtgtctacgtacagtgctgatggcgcgagggaggc

SEQ ID NO: 5588 - DNA, 396 bp, Artificial Sequence
  source: /note="Description of Artificial Sequence: Synthetic polynucleotide"
gccttgccagcccgctcagtgctacacgtacagtggtgggcacggacactgtccacctaagccaggggcagacccgagtgtccccgcagtagacctgagagcgctgggcccacagcctcccctcggtgccctgctacctcctcaggtcagccctggacatcccgggtttccccaggctggcggtaggtttggggtgaggtctgtgtcactgtggtattacgatttttggagtggttatttgctacacgtacagtggtcgacatacttccagcactggggccagggcaccctggtcaccgtctcctcaggtgagtctgctgtctggggatagcggggagccaggtgtactgggccaggcaagtgctacacgtacagtgctgatggcgcgagggaggc

SEQ ID NO: 5589 - DNA, 396 bp, Artificial Sequence
  source: /note="Description of Artificial Sequence: Synthetic polynucleotide"
gccttgccagcccgctcagaactgccagtacagtgtgggcacggacactatccacataagcgagggatagacccgagtgtccccacagcagacctgagagcgctgggcccacagcctcccctcagagccctgctgcctcctccggtcagccctggacatcccaggtttccccaggcctgccggtaggtttagaatgaggtctgtgtcactgtggtattacgatattttgactggttattaactgccagtacagtggtcgacatacttccagcactggggccagggcaccctggtcaccgtctcctcaggtgagtctgctgtctggggatagcggggagccaggtgtactgggccaggcaagaactgccagtacagtgctgatggcgcgagggaggc

SEQ ID NO: 5590 - DNA, 396 bp, Artificial Sequence
  source: /note="Description of Artificial Sequence: Synthetic polynucleotide"
gccttgccagcccgctcagttggactggtacagtgcgatattttgactggttattataaccacagtgtcacagagtccatcaaaaacccatgcctggaagcttcccgccacagccctccccatggggccctgctgcctcctcaggtcagccccggacatcccgggtttccccaggctgggcggtaggtttggggtgaggtctgtgtcactgtggtattactatggttcggggagttattttggactggtacagtggtcgacatacttccagcactggggccagggcaccctggtcaccgtctcctcaggtgagtctgctgtctggggatagcggggagccaggtgtactgggccaggcaagttggactggtacagtgctgatggcgcgagggaggc

SEQ ID NO: 5591 - DNA, 402 bp, Artificial Sequence
  source: /note="Description of Artificial Sequence: Synthetic polynucleotide"
gccttgccagcccgctcaggtagacacgtacagtgtggacgcggacactatccacataagcgagggacagacccgagtgttcctgcagtagacctgagagcgctgggcccacagcctcccctcggtgccctgctgcctcctcaggtcagccctggacatcccgggtttccccaggccagatggtaggtttgaagtgaggtctgtgtcactgtggtattatgattacgtttgggggagttatcgttgtagacacgtacagtggtcgacatacttccagcactggggccagggcaccctggtcaccgtctcctcaggtgagtctgctgtctggggatagcggggagccaggtgtactgggccaggcaaggtagacacgtacagtgctgatggcgcgagggaggc

SEQ ID NO: 5592 - DNA, 396 bp, Artificial Sequence
  source: /note="Description of Artificial Sequence: Synthetic polynucleotide"
gccttgccagcccgctcagcactgtacgtacagtgtgggcatggacagtgtccacctaagcgagggacagacccgagtgtccctgcagtagacctgagagcgctgggcccacagcctcccctcggggccctgctgcctcctcaggtcagccctggacatcccgggtttccccaggcctggcggtaggtttgaagtgaggtctgtgtcactgtggtattactatgatagtagtggttattcactgtacgtacagtggtcgacatacttccagcactggggccagggcaccctggtcaccgtctcctcaggtgagtctgctgtctggggatagcggggagccaggtgtactgggccaggcaagcactgtacgtacagtgctgatggcgcgagggaggc

SEQ ID NO: 5593 - DNA, 381 bp, Artificial Sequence
  source: /note="Description of Artificial Sequence: Synthetic polynucleotide"
gccttgccagcccgctcaggatgatccgtacagtgcaagggtgagtcagaccctcctgccctcgatggcaggcggagaagattcagaaaggtctgagatccccaggacgcagcaccactgtcaatgggggccccagacgcctggaccagggcctgcgtgggaaaggcctctgggcacactcaggggctttttgtgaagggtcctcctactgtgtgactacagtagatgatccgtacagtggtcgacatacttccagcactggggccagggcaccctggtcaccgtctcctcaggtgagtctgctgtctggggatagcggggagccaggtgtactgggccaggcaaggatgatccgtacagtgctgatggcgcgagggaggc

SEQ ID NO: 5594 - DNA, 381 bp, Artificial Sequence
  source: /note="Description of Artificial Sequence: Synthetic polynucleotide"
gccttgccagcccgctcagcgccaatagtacagtgtgcctctctccccagtggacaccctcttccaggacagtcctcagtggcatcacagcggcctgagatccccaggacgcagcaccgctgtcaataggggccccaaatgcctggaccagggcctgcgtgggaaaggtctctggccacactcgggctttttgtgaagggccctcctgctgtgtgactacagtacgccaatagtacagtggtcgacatacttccagcactggggccagggcaccctggtcaccgtctcctcaggtgagtctgctgtctggggatagcggggagccaggtgtactgggccaggcaagcgccaatagtacagtgctgatggcgcgagggaggc

SEQ ID NO: 5595 - DNA, 381 bp, Artificial Sequence
  source: /note="Description of Artificial Sequence: Synthetic polynucleotide"
gccttgccagcccgctcagtcaagcctgtacagtgggagggtgagtcagacccacctgccctcgatggcaggcggggaagattcagaaaggcctgagatccccaggacgcagcaccactgtcaatgggggccccagacgcctggaccagggcctgcgtgggaaaggccgctgggcacactcaggggctttttgtgaaggcccctcctactgtgtgactacggtgtcaagcctgtacagtggtcgacatacttccagcactggggccagggcaccctggtcaccgtctcctcaggtgagtctgctgtctggggatagcggggagccaggtgtactgggccaggcaagtcaagcctgtacagtgctgatggcgcgagggaggc

SEQ ID NO: 5596 - DNA, 384 bp, Artificial Sequence
  source: /note="Description of Artificial Sequence: Synthetic polynucleotide"
gccttgccagcccgctcagacgtgtgtgtacagtgggagggtgagtcagacccacctgccctcaatggcaggcggggaagattcagaaaggcctgagatccccaggacgcagcaccactgtcaatgggggccccagacgcctggaccagggcctgtgtgggaaaggcctctggccacactcaggggctttttgtgaagggccctcctgctgtgtgactacggtggtaacgtgtgtgtacagtggtcgacatacttccagcactggggccagggcaccctggtcaccgtctcctcaggtgagtctgctgtctggggatagcggggagccaggtgtactgggccaggcaagacgtgtgtgtacagtgctgatggcgcgagggaggc

SEQ ID NO: 5597 - DNA, 385 bp, Artificial Sequence
  source: /note="Description of Artificial Sequence: Synthetic polynucleotide"
gccttgccagcccgctcagtccgtctagtacagtgagaggcctctccagggggacactgtgcatgtctggtccctgagcagccccccatgtccccagtcctggggggccccctggcacagctgtctggaccctctctattccctgggaagctcctcctgacagccccgcctccagttccaggtgtggttattgtcagggggtgtcagactgtggtggatacagctatgtccgtctagtacagtggtcgacatacttccagcactggggccagggcaccctggtcaccgtctcctcaggtgagtctgctgtctggggatagcggggagccaggtgtactgggccaggcaagtccgtctagtacagtgctgatggcgcgagggaggc

SEQ ID NO: 5598 - DNA, 388 bp, Artificial Sequence
  source: /note="Description of Artificial Sequence: Synthetic polynucleotide"
gccttgccagcccgctcagaagagctggtacagtggcagaggcctctccagggagacactgtgcatgtctggtacctaagcagccccccacgtccccagtcctgggggcccctggctcagctgtctggaccctccctgttccctgggaagctcctcctgacagccccgcctccagttccaggtgtggttattgtcaggcgatgtcagactgtggtggatatagtggctacgaagagctggtacagtggtcgacatacttccagcactggggccagggcaccctggtcaccgtctcctcaggtgagtctgctgtctggggatagcggggagccaggtgtactgggccaggcaagaagagctggtacagtgctgatggcgcgagggaggc

SEQ ID NO: 5599 - DNA, 385 bp, Artificial Sequence
  source: /note="Description of Artificial Sequence: Synthetic polynucleotide"
gccttgccagcccgctcagtatcgctcgtacagtggcagaggcctctccagggggacactgtgcatgtctggtccctgagcagccccccacgtccccagtcctgggggcccctggcacagctgtctggaccctccctgttccctgggaagctcctcctgacagccccgcctccagttccaggtgtggttattgtcagggggtgtcagactgtggtggatacagctatgtatcgctcgtacagtggtcgacatacttccagcactggggccagggcaccctggtcaccgtctcctcaggtgagtctgctgtctggggatagcggggagccaggtgtactgggccaggcaagtatcgctcgtacagtgctgatggcgcgagggaggc

SEQ ID NO: 5600 - DNA, 385 bp, Artificial Sequence
  source: /note="Description of Artificial Sequence: Synthetic polynucleotide"
gccttgccagcccgctcagtcagatgcgtacagtggcagaggcctctccagggggacacagtgcatgtctggtccctgagcagcccccaggctctctagcactgggggcccctggcacagctgtctggaccctccctgttccctgggaagctcctcctgacagccccgcctccagttccaggtgtggttattgtcagggggtgccaggccgtggtagagatggctacatcagatgcgtacagtggtcgacatacttccagcactggggccagggcaccctggtcaccgtctcctcaggtgagtctgctgtctggggatagcggggagccaggtgtactgggccaggcaagtcagatgcgtacagtgctgatggcgcgagggaggc

SEQ ID NO: 5601 - DNA, 383 bp, Artificial Sequence
  source: /note="Description of Artificial Sequence: Synthetic polynucleotide"
gccttgccagcccgctcaggtgtagcagtacagtgaggcagctgactcctgacttggacgcctattccagacaccagacagaggggcaggccccccagaaccagggatgaggacgccccgtcaaggccagaaaagaccaagttgtgctgagcccagcaagggaaggtccccaaacaaaccaggaacgtttctgaaggtgtctgtgtcacagtggagtatagcagctgtgtagcagtacagtggtcgacatacttccagcactggggccagggcaccctggtcaccgtctcctcaggtgagtctgctgtctggggatagcggggagccaggtgtactgggccaggcaaggtgtagcagtacagtgctgatggcgcgagggaggc

SEQ ID NO: 5602 - DNA, 386 bp, Artificial Sequence
  source: /note="Description of Artificial Sequence: Synthetic polynucleotide"
gccttgccagcccgctcagtggcagttgtacagtgaggcagctgacccctgacttggacccctattccagacaccagacagaggcgcaggccccccagaaccagggttgagggacgccccgtcaaagccagacaaaaccaaggggtgttgagcccagcaagggaaggcccccaaacagaccaggaggtttctgaaggtgtctgtgtcacagtggggtatagcagcagcttggcagttgtacagtggtcgacatacttccagcactggggccagggcaccctggtcaccgtctcctcaggtgagtctgctgtctggggatagcggggagccaggtgtactgggccaggcaagtggcagttgtacagtgctgatggcgcgagggaggc

SEQ ID NO: 5603 - DNA, 386 bp, Artificial Sequence
  source: /note="Description of Artificial Sequence: Synthetic polynucleotide"
gccttgccagcccgctcagcagtccaagtacagtgtgaggtagctggcctctgtctcggaccccactccagacaccagacagaggggcaggccccccaaaaccagggttgagggatgatccgtcaaggcagacaagaccaaggggcactgaccccagcaagggaaggctcccaaacagacgaggaggtttctgaagctgtctgtatcacagtggggtatagcagtggctcagtccaagtacagtggtcgacatacttccagcactggggccagggcaccctggtcaccgtctcctcaggtgagtctgctgtctggggatagcggggagccaggtgtactgggccaggcaagcagtccaagtacagtgctgatggcgcgagggaggc

SEQ ID NO: 5604 - DNA, 383 bp, Artificial Sequence
  source: /note="Description of Artificial Sequence: Synthetic polynucleotide"
gccttgccagcccgctcagtacgtacggtacagtgcagctggcctctgtctcggacccccattccagacaccagacagagggacaggccccccagaaccagtgttgagggacacccctgtccagggcagccaagtccaagaggcgcgctgagcccagcaagggaaggcccccaaacaaaccaggaggtttctgaagctgtctgtgtcacagtcgggtatagcagcgtacgtacggtacagtggtcgacatacttccagcactggggccagggcaccctggtcaccgtctcctcaggtgagtctgctgtctggggatagcggggagccaggtgtactgggccaggcaagtacgtacggtacagtgctgatggcgcgagggaggc

SEQ ID NO: 5605 - DNA, 377 bp, Artificial Sequence
  source: /note="Description of Artificial Sequence: Synthetic polynucleotide"
gccttgccagcccgctcagagtaccgagtacagtgagggttgagggctggggtctcccacgtgttttggggctaacagcggaagggagagcactggcaaaggtgctgggggtcccctgaacccgacccgccctgagaccgcagccacatcagcccccagccccacaggccccctaccagccgcagggtttttggctgagctgagaaccactgtgctaactagtaccgagtacagtggtcgacatacttccagcactggggccagggcaccctggtcaccgtctcctcaggtgagtctgctgtctggggatagcggggagccaggtgtactgggccaggcaagagtaccgagtacagtgctgatggcgcgagggaggc

SEQ ID NO: 5606 - DNA, 382 bp, Artificial Sequence
  source: /note="Description of Artificial Sequence: Synthetic polynucleotide"
gccttgccagcccgctcaggacactctggatcatcgccccggtctctgtgggtgttccgctaactggggctcccagtgctcaccccacaactaaagcgagccccagcctccagagcccccgaaggagatgccgcccacaagcccagcccccatccaggaggccccagagctcagggcgccggggcagattctgaacagccccgagtcacggtgggtacaactggagacactctggatcatcgtcgactgctgggggcccctggacccgacccgccctggagaccgcagccacatcagcccccagccccacaggccccctaccagccgcagggttttggctgagctgagacactctggatcatcctgatggcgcgagggaggc

SEQ ID NO: 5607 - DNA, 382 bp, Artificial Sequence
  source: /note="Description of Artificial Sequence: Synthetic polynucleotide"
gccttgccagcccgctcagttcggaacggatcatcggcctcggtctctgtgggtgttccgctagctggggctcacagtgctcaccccacacctaaaacgagccacagcctcagagcccctgaaggagaccccgcccacaagcccagcccccacccaggaggccccagagcacagggcgccccgtcggattctgaacagccccgagtcacagtgggtataactggattcggaacggatcatcgtcgactgctgggggcccctggacccgacccgccctggagaccgcagccacatcagcccccagccccacaggccccctaccagccgcagggttttggctgagctgattcggaacggatcatcctgatggcgcgagggaggc

SEQ ID NO: 5608 - DNA, 382 bp, Artificial Sequence
  source: /note="Description of Artificial Sequence: Synthetic polynucleotide"
gccttgccagcccgctcagaagtaacgggatcatcggcctcggtctctgtgggtgttccgctagctggggctcacagtgctcaccccacacctaaaatgagccacagcctccggagcccccgcagagaccccgcccacaagcccagcccccacccaggaggccccagagctcagggcgccccgtcggattccgaacagccccgagtcacagcgggtataaccggaaagtaacgggatcatcgtcgactgctgggggcccctggacccgacccgccctggagaccgcagccacatcagcccccagccccacaggccccctaccagccgcagggttttggctgagctgaaagtaacgggatcatcctgatggcgcgagggaggc

SEQ ID NO: 5609 - DNA, 382 bp, Artificial Sequence
  source: /note="Description of Artificial Sequence: Synthetic polynucleotide"
gccttgccagcccgctcaggtctcctaggatcatcgtctctgtgggtgttccgctagctggggcccccagtgctcaccccacacctaaagcgagccccagcctccagagccccctaagcattccccgcccagcagcccagcccctgcccccacccaggaggccccagagctcagggcgcctggtcggattctgaacagccccgagtcacagtgggtataactggagtctcctaggatcatcgtcgactgctgggggcccctggacccgacccgccctggagaccgcagccacatcagcccccagccccacaggccccctaccagccgcagggttttggctgagctgagtctcctaggatcatcctgatggcgcgagggaggc

SEQ ID NO: 5610 - DNA, 385 bp, Artificial Sequence
  source: /note="Description of Artificial Sequence: Synthetic polynucleotide"
gccttgccagcccgctcagagagtgtcggatcatcaggcctcaggctctgtgggtgccgctagctggggctgccagtcctcaccccacacctaaggtgagccacagccgccagagcctccacaggagaccccacccagcagcccagcccctacccaggaggccccagagctcagggcgcctgggtggattctgaacagccccgagtcacggtgggtatagtgggagctagagtgtcggatcatcgtcgactgctgggggcccctggacccgacccgccctggagaccgcagccacatcagcccccagccccacaggccccctaccagccgcagggttttggctgagctgaagagtgtcggatcatcctgatggcgcgagggaggc

SEQ ID NO: 5611 - DNA, 396 bp, Artificial Sequence
  source: /note="Description of Artificial Sequence: Synthetic polynucleotide"
gccttgccagcccgctcaggttccgaaggatcatcaaaggaggagccccctgtacagcactgggctcagagtcctctcccacacaccctgagtttcagacaaaaaccccctggaaatcatagtatcagcaggagaactagccagagacagcaagaggggactcagtgactcccgcggggacaggaggattttgtgggggctcgtgtcactgtgaggatattgtagtagtaccagctgctgttccgaaggatcatcgtcgactgctgggggcccctggacccgacccgccctggagaccgcagccacatcagcccccagccccacaggccccctaccagccgcagggttttggctgagctgagttccgaaggatcatcctgatggcgcgagggaggc

SEQ ID NO: 5612 - DNA, 396 bp, Artificial Sequence
  source: /note="Description of Artificial Sequence: Synthetic polynucleotide"
gccttgccagcccgctcagcgttacttggatcatcaaaggaggagccccttgttcagcactgggctcagagtcctctccaagacacccagagtttcagacaaaaaccccctggaatgcacagtctcagcaggagagccagccagagccagcaagatggggctcagtgacacccgcagggacaggaggattttgtgggggctcgtgtcactgtgaggatattgtactaatggtgtatgctcgttacttggatcatcgtcgactgctgggggcccctggacccgacccgccctggagaccgcagccacatcagcccccagccccacaggccccctaccagccgcagggttttggctgagctgacgttacttggatcatcctgatggcgcgagggaggc

SEQ ID NO: 5613 - DNA, 396 bp, Artificial Sequence
  source: /note="Description of Artificial Sequence: Synthetic polynucleotide"
gccttgccagcccgctcagtaggagacggatcatcaaaggaggagccccctatacagcactgggctcagagtcctctctgagacaccctgagtttcagacaacaacccgctggaatgcacagtctcagcaggagaacagaccaaagccagcaaaagggacctcggtgacaccagtagggacaggaggattttgtgggggctcgtgtcactgtgaggatattgtagtggtggtagctgcttaggagacggatcatcgtcgactgctgggggcccctggacccgacccgccctggagaccgcagccacatcagcccccagccccacaggccccctaccagccgcagggttttggctgagctgataggagacggatcatcctgatggcgcgagggaggc

SEQ ID NO: 5614 - DNA, 393 bp, Artificial Sequence
  source: /note="Description of Artificial Sequence: Synthetic polynucleotide"
gccttgccagcccgctcaggtgtctacggatcatcagccccctgtacagcactgggctcagagtcctctctgagacaggctcagtttcagacaacaacccgctggaatgcacagtctcagcaggagagccaggccagagccagcaagaggagactcggtgacaccagtctcctgtagggacaggaggattttgtgggggttcgtgtcactgtgagcatattgtggtggtgactgctgtgtctacggatcatcgtcgactgctgggggcccctggacccgacccgccctggagaccgcagccacatcagcccccagccccacaggccccctaccagccgcagggttttggctgagctgagtgtctacggatcatcctgatggcgcgagggaggc

SEQ ID NO: 5615 - DNA, 396 bp, Artificial Sequence
  source: /note="Description of Artificial Sequence: Synthetic polynucleotide"
gccttgccagcccgctcagtgctacacggatcatcgtgggcacggacactgtccacctaagccaggggcagacccgagtgtccccgcagtagacctgagagcgctgggcccacagcctcccctcggtgccctgctacctcctcaggtcagccctggacatcccgggtttccccaggctggcggtaggtttggggtgaggtctgtgtcactgtggtattacgatttttggagtggttatttgctacacggatcatcgtcgactgctgggggcccctggacccgacccgccctggagaccgcagccacatcagcccccagccccacaggccccctaccagccgcagggttttggctgagctgatgctacacggatcatcctgatggcgcgagggaggc

SEQ ID NO: 5616 - DNA, 396 bp, Artificial Sequence
  source: /note="Description of Artificial Sequence: Synthetic polynucleotide"
gccttgccagcccgctcagaactgccaggatcatctgggcacggacactatccacataagcgagggatagacccgagtgtccccacagcagacctgagagcgctgggcccacagcctcccctcagagccctgctgcctcctccggtcagccctggacatcccaggtttccccaggcctgccggtaggtttagaatgaggtctgtgtcactgtggtattacgatattttgactggttattaactgccaggatcatcgtcgactgctgggggcccctggacccgacccgccctggagaccgcagccacatcagcccccagccccacaggccccctaccagccgcagggttttggctgagctgaaactgccaggatcatcctgatggcgcgagggaggc

SEQ ID NO: 5617 - DNA, 396 bp, Artificial Sequence
  source: /note="Description of Artificial Sequence: Synthetic polynucleotide"
gccttgccagcccgctcagttggactgggatcatccgatattttgactggttattataaccacagtgtcacagagtccatcaaaaacccatgcctggaagcttcccgccacagccctccccatggggccctgctgcctcctcaggtcagccccggacatcccgggtttccccaggctgggcggtaggtttggggtgaggtctgtgtcactgtggtattactatggttcggggagttattttggactgggatcatcgtcgactgctgggggcccctggacccgacccgccctggagaccgcagccacatcagcccccagccccacaggccccctaccagccgcagggttttggctgagctgattggactgggatcatcctgatggcgcgagggaggc

SEQ ID NO: 5618 - DNA, 402 bp, Artificial Sequence
  source: /note="Description of Artificial Sequence: Synthetic polynucleotide"
gccttgccagcccgctcaggtagacacggatcatctggacgcggacactatccacataagcgagggacagacccgagtgttcctgcagtagacctgagagcgctgggcccacagcctcccctcggtgccctgctgcctcctcaggtcagccctggacatcccgggtttccccaggccagatggtaggtttgaagtgaggtctgtgtcactgtggtattatgattacgtttgggggagttatcgttgtagacacggatcatcgtcgactgctgggggcccctggacccgacccgccctggagaccgcagccacatcagcccccagccccacaggccccctaccagccgcagggttttggctgagctgagtagacacggatcatcctgatggcgcgagggaggc

SEQ ID NO: 5619 - DNA, 396 bp, Artificial Sequence
  source: /note="Description of Artificial Sequence: Synthetic polynucleotide"
gccttgccagcccgctcagcactgtacggatcatctgggcatggacagtgtccacctaagcgagggacagacccgagtgtccctgcagtagacctgagagcgctgggcccacagcctcccctcggggccctgctgcctcctcaggtcagccctggacatcccgggtttccccaggcctggcggtaggtttgaagtgaggtctgtgtcactgtggtattactatgatagtagtggttattcactgtacggatcatcgtcgactgctgggggcccctggacccgacccgccctggagaccgcagccacatcagcccccagccccacaggccccctaccagccgcagggttttggctgagctgacactgtacggatcatcctgatggcgcgagggaggc

SEQ ID NO: 5620 - DNA, 381 bp, Artificial Sequence
  source: /note="Description of Artificial Sequence: Synthetic polynucleotide"
gccttgccagcccgctcaggatgatccggatcatccaagggtgagtcagaccctcctgccctcgatggcaggcggagaagattcagaaaggtctgagatccccaggacgcagcaccactgtcaatgggggccccagacgcctggaccagggcctgcgtgggaaaggcctctgggcacactcaggggctttttgtgaagggtcctcctactgtgtgactacagtagatgatccggatcatcgtcgactgctgggggcccctggacccgacccgccctggagaccgcagccacatcagcccccagccccacaggccccctaccagccgcagggttttggctgagctgagatgatccggatcatcctgatggcgcgagggaggc

SEQ ID NO: 5621 - DNA, 381 bp, Artificial Sequence
  source: /note="Description of Artificial Sequence: Synthetic polynucleotide"
gccttgccagcccgctcagcgccaataggatcatctgcctctctccccagtggacaccctcttccaggacagtcctcagtggcatcacagcggcctgagatccccaggacgcagcaccgctgtcaataggggccccaaatgcctggaccagggcctgcgtgggaaaggtctctggccacactcgggctttttgtgaagggccctcctgctgtgtgactacagtacgccaataggatcatcgtcgactgctgggggcccctggacccgacccgccctggagaccgcagccacatcagcccccagccccacaggccccctaccagccgcagggttttggctgagctgacgccaataggatcatcctgatggcgcgagggaggc

SEQ ID NO: 5622 - DNA, 381 bp, Artificial Sequence
  source: /note="Description of Artificial Sequence: Synthetic polynucleotide"
gccttgccagcccgctcagtcaagcctggatcatcggagggtgagtcagacccacctgccctcgatggcaggcggggaagattcagaaaggcctgagatccccaggacgcagcaccactgtcaatgggggccccagacgcctggaccagggcctgcgtgggaaaggccgctgggcacactcaggggctttttgtgaaggcccctcctactgtgtgactacggtgtcaagcctggatcatcgtcgactgctgggggcccctggacccgacccgccctggagaccgcagccacatcagcccccagccccacaggccccctaccagccgcagggttttggctgagctgatcaagcctggatcatcctgatggcgcgagggaggc

SEQ ID NO: 5623 - DNA, 384 bp, Artificial Sequence
  source: /note="Description of Artificial Sequence: Synthetic polynucleotide"
gccttgccagcccgctcagacgtgtgtggatcatcggagggtgagtcagacccacctgccctcaatggcaggcggggaagattcagaaaggcctgagatccccaggacgcagcaccactgtcaatgggggccccagacgcctggaccagggcctgtgtgggaaaggcctctggccacactcaggggctttttgtgaagggccctcctgctgtgtgactacggtggtaacgtgtgtggatcatcgtcgactgctgggggcccctggacccgacccgccctggagaccgcagccacatcagcccccagccccacaggccccctaccagccgcagggttttggctgagctgaacgtgtgtggatcatcctgatggcgcgagggaggc

SEQ ID NO: 5624 - DNA, 385 bp, Artificial Sequence
  source: /note="Description of Artificial Sequence: Synthetic polynucleotide"
gccttgccagcccgctcagtccgtctaggatcatcagaggcctctccagggggacactgtgcatgtctggtccctgagcagccccccatgtccccagtcctggggggccccctggcacagctgtctggaccctctctattccctgggaagctcctcctgacagccccgcctccagttccaggtgtggttattgtcagggggtgtcagactgtggtggatacagctatgtccgtctaggatcatcgtcgactgctgggggcccctggacccgacccgccctggagaccgcagccacatcagcccccagccccacaggccccctaccagccgcagggttttggctgagctgatccgtctaggatcatcctgatggcgcgagggaggc

SEQ ID NO: 5625 - DNA, 388 bp, Artificial Sequence
  source: /note="Description of Artificial Sequence: Synthetic polynucleotide"
gccttgccagcccgctcagaagagctgggatcatcgcagaggcctctccagggagacactgtgcatgtctggtacctaagcagccccccacgtccccagtcctgggggcccctggctcagctgtctggaccctccctgttccctgggaagctcctcctgacagccccgcctccagttccaggtgtggttattgtcaggcgatgtcagactgtggtggatatagtggctacgaagagctgggatcatcgtcgactgctgggggcccctggacccgacccgccctggagaccgcagccacatcagcccccagccccacaggccccctaccagccgcagggttttggctgagctgaaagagctgggatcatcctgatggcgcgagggaggc

SEQ ID NO: 5626 - DNA, 385 bp, Artificial Sequence
  source: /note="Description of Artificial Sequence: Synthetic polynucleotide"
gccttgccagcccgctcagtatcgctcggatcatcgcagaggcctctccagggggacactgtgcatgtctggtccctgagcagccccccacgtccccagtcctgggggcccctggcacagctgtctggaccctccctgttccctgggaagctcctcctgacagccccgcctccagttccaggtgtggttattgtcagggggtgtcagactgtggtggatacagctatgtatcgctcggatcatcgtcgactgctgggggcccctggacccgacccgccctggagaccgcagccacatcagcccccagccccacaggccccctaccagccgcagggttttggctgagctgatatcgctcggatcatcctgatggcgcgagggaggc

SEQ ID NO: 5627 - DNA, 385 bp, Artificial Sequence
  source: /note="Description of Artificial Sequence: Synthetic polynucleotide"
gccttgccagcccgctcagtcagatgcggatcatcgcagaggcctctccagggggacacagtgcatgtctggtccctgagcagcccccaggctctctagcactgggggcccctggcacagctgtctggaccctccctgttccctgggaagctcctcctgacagccccgcctccagttccaggtgtggttattgtcagggggtgccaggccgtggtagagatggctacatcagatgcggatcatcgtcgactgctgggggcccctggacccgacccgccctggagaccgcagccacatcagcccccagccccacaggccccctaccagccgcagggttttggctgagctgatcagatgcggatcatcctgatggcgcgagggaggc

SEQ ID NO: 5628 - DNA, 383 bp, Artificial Sequence
  source: /note="Description of Artificial Sequence: Synthetic polynucleotide"
gccttgccagcccgctcaggtgtagcaggatcatcaggcagctgactcctgacttggacgcctattccagacaccagacagaggggcaggccccccagaaccagggatgaggacgccccgtcaaggccagaaaagaccaagttgtgctgagcccagcaagggaaggtccccaaacaaaccaggaacgtttctgaaggtgtctgtgtcacagtggagtatagcagctgtgtagcaggatcatcgtcgactgctgggggcccctggacccgacccgccctggagaccgcagccacatcagcccccagccccacaggccccctaccagccgcagggttttggctgagctgagtgtagcaggatcatcctgatggcgcgagggaggc

SEQ ID NO: 5629 - DNA, 386 bp, Artificial Sequence
  source: /note="Description of Artificial Sequence: Synthetic polynucleotide"
gccttgccagcccgctcagtggcagttggatcatcaggcagctgacccctgacttggacccctattccagacaccagacagaggcgcaggccccccagaaccagggttgagggacgccccgtcaaagccagacaaaaccaaggggtgttgagcccagcaagggaaggcccccaaacagaccaggaggtttctgaaggtgtctgtgtcacagtggggtatagcagcagcttggcagttggatcatcgtcgactgctgggggcccctggacccgacccgccctggagaccgcagccacatcagcccccagccccacaggccccctaccagccgcagggttttggctgagctgatggcagttggatcatcctgatggcgcgagggaggc

SEQ ID NO: 5630 - DNA, 386 bp, Artificial Sequence
  source: /note="Description of Artificial Sequence: Synthetic polynucleotide"
gccttgccagcccgctcagcagtccaaggatcatctgaggtagctggcctctgtctcggaccccactccagacaccagacagaggggcaggccccccaaaaccagggttgagggatgatccgtcaaggcagacaagaccaaggggcactgaccccagcaagggaaggctcccaaacagacgaggaggtttctgaagctgtctgtatcacagtggggtatagcagtggctcagtccaaggatcatcgtcgactgctgggggcccctggacccgacccgccctggagaccgcagccacatcagcccccagccccacaggccccctaccagccgcagggttttggctgagctgacagtccaaggatcatcctgatggcgcgagggaggc

SEQ ID NO: 5631 - DNA, 383 bp, Artificial Sequence
  source: /note="Description of Artificial Sequence: Synthetic polynucleotide"
gccttgccagcccgctcagtacgtacgggatcatccagctggcctctgtctcggacccccattccagacaccagacagagggacaggccccccagaaccagtgttgagggacacccctgtccagggcagccaagtccaagaggcgcgctgagcccagcaagggaaggcccccaaacaaaccaggaggtttctgaagctgtctgtgtcacagtcgggtatagcagcgtacgtacgggatcatcgtcgactgctgggggcccctggacccgacccgccctggagaccgcagccacatcagcccccagccccacaggccccctaccagccgcagggttttggctgagctgatacgtacgggatcatcctgatggcgcgagggaggc

SEQ ID NO: 5632 - DNA, 377 bp, Artificial Sequence
  source: /note="Description of Artificial Sequence: Synthetic polynucleotide"
gccttgccagcccgctcagagtaccgaggatcatcagggttgagggctggggtctcccacgtgttttggggctaacagcggaagggagagcactggcaaaggtgctgggggtcccctgaacccgacccgccctgagaccgcagccacatcagcccccagccccacaggccccctaccagccgcagggtttttggctgagctgagaaccactgtgctaactagtaccgaggatcatcgtcgactgctgggggcccctggacccgacccgccctggagaccgcagccacatcagcccccagccccacaggccccctaccagccgcagggttttggctgagctgaagtaccgaggatcatcctgatggcgcgagggaggc

SEQ ID NO: 5633 - DNA, 382 bp, Artificial Sequence
  source: /note="Description of Artificial Sequence: Synthetic polynucleotide"
gccttgccagcccgctcaggacactcttattggcggccccggtctctgtgggtgttccgctaactggggctcccagtgctcaccccacaactaaagcgagccccagcctccagagcccccgaaggagatgccgcccacaagcccagcccccatccaggaggccccagagctcagggcgccggggcagattctgaacagccccgagtcacggtgggtacaactggagacactcttattggcggtcgacggtacttcgatctctggggccgtggcaccctggtcactgtctcctcaggtgagtcccactgcagccccctcccagtcttctctgtccaggcaccaggccagacactcttattggcgctgatggcgcgagggaggc

SEQ ID NO: 5634 - DNA, 382 bp, Artificial Sequence
  source: /note="Description of Artificial Sequence: Synthetic polynucleotide"
gccttgccagcccgctcagttcggaactattggcgggcctcggtctctgtgggtgttccgctagctggggctcacagtgctcaccccacacctaaaacgagccacagcctcagagcccctgaaggagaccccgcccacaagcccagcccccacccaggaggccccagagcacagggcgccccgtcggattctgaacagccccgagtcacagtgggtataactggattcggaactattggcggtcgacggtacttcgatctctggggccgtggcaccctggtcactgtctcctcaggtgagtcccactgcagccccctcccagtcttctctgtccaggcaccaggccattcggaactattggcgctgatggcgcgagggaggc

SEQ ID NO: 5635 - DNA, 382 bp, Artificial Sequence
  source: /note="Description of Artificial Sequence: Synthetic polynucleotide"
gccttgccagcccgctcagaagtaacgtattggcgggcctcggtctctgtgggtgttccgctagctggggctcacagtgctcaccccacacctaaaatgagccacagcctccggagcccccgcagagaccccgcccacaagcccagcccccacccaggaggccccagagctcagggcgccccgtcggattccgaacagccccgagtcacagcgggtataaccggaaagtaacgtattggcggtcgacggtacttcgatctctggggccgtggcaccctggtcactgtctcctcaggtgagtcccactgcagccccctcccagtcttctctgtccaggcaccaggccaaagtaacgtattggcgctgatggcgcgagggaggc

SEQ ID NO: 5636 - DNA, 382 bp, Artificial Sequence
  source: /note="Description of Artificial Sequence: Synthetic polynucleotide"
gccttgccagcccgctcaggtctcctatattggcggtctctgtgggtgttccgctagctggggcccccagtgctcaccccacacctaaagcgagccccagcctccagagccccctaagcattccccgcccagcagcccagcccctgcccccacccaggaggccccagagctcagggcgcctggtcggattctgaacagccccgagtcacagtgggtataactggagtctcctatattggcggtcgacggtacttcgatctctggggccgtggcaccctggtcactgtctcctcaggtgagtcccactgcagccccctcccagtcttctctgtccaggcaccaggccagtctcctatattggcgctgatggcgcgagggaggc

SEQ ID NO: 5637 - DNA, 385 bp, Artificial Sequence
  source: /note="Description of Artificial Sequence: Synthetic polynucleotide"
gccttgccagcccgctcagagagtgtctattggcgaggcctcaggctctgtgggtgccgctagctggggctgccagtcctcaccccacacctaaggtgagccacagccgccagagcctccacaggagaccccacccagcagcccagcccctacccaggaggccccagagctcagggcgcctgggtggattctgaacagccccgagtcacggtgggtatagtgggagctagagtgtctattggcggtcgacggtacttcgatctctggggccgtggcaccctggtcactgtctcctcaggtgagtcccactgcagccccctcccagtcttctctgtccaggcaccaggccaagagtgtctattggcgctgatggcgcgagggaggc

SEQ ID NO: 5638 - DNA, 396 bp, Artificial Sequence
  source: /note="Description of Artificial Sequence: Synthetic polynucleotide"
gccttgccagcccgctcaggttccgaatattggcgaaaggaggagccccctgtacagcactgggctcagagtcctctcccacacaccctgagtttcagacaaaaaccccctggaaatcatagtatcagcaggagaactagccagagacagcaagaggggactcagtgactcccgcggggacaggaggattttgtgggggctcgtgtcactgtgaggatattgtagtagtaccagctgctgttccgaatattggcggtcgacggtacttcgatctctggggccgtggcaccctggtcactgtctcctcaggtgagtcccactgcagccccctcccagtcttctctgtccaggcaccaggccagttccgaatattggcgctgatggcgcgagggaggc

SEQ ID NO: 5639 - DNA, 396 bp, Artificial Sequence
  source: /note="Description of Artificial Sequence: Synthetic polynucleotide"
gccttgccagcccgctcagcgttactttattggcgaaaggaggagccccttgttcagcactgggctcagagtcctctccaagacacccagagtttcagacaaaaaccccctggaatgcacagtctcagcaggagagccagccagagccagcaagatggggctcagtgacacccgcagggacaggaggattttgtgggggctcgtgtcactgtgaggatattgtactaatggtgtatgctcgttactttattggcggtcgacggtacttcgatctctggggccgtggcaccctggtcactgtctcctcaggtgagtcccactgcagccccctcccagtcttctctgtccaggcaccaggccacgttactttattggcgctgatggcgcgagggaggc

SEQ ID NO: 5640 - DNA, 396 bp, Artificial Sequence
  source: /note="Description of Artificial Sequence: Synthetic polynucleotide"
gccttgccagcccgctcagtaggagactattggcgaaaggaggagccccctatacagcactgggctcagagtcctctctgagacaccctgagtttcagacaacaacccgctggaatgcacagtctcagcaggagaacagaccaaagccagcaaaagggacctcggtgacaccagtagggacaggaggattttgtgggggctcgtgtcactgtgaggatattgtagtggtggtagctgcttaggagactattggcggtcgacggtacttcgatctctggggccgtggcaccctggtcactgtctcctcaggtgagtcccactgcagccccctcccagtcttctctgtccaggcaccaggccataggagactattggcgctgatggcgcgagggaggc

SEQ ID NO: 5641 - DNA, 393 bp, Artificial Sequence
  source: /note="Description of Artificial Sequence: Synthetic polynucleotide"
gccttgccagcccgctcaggtgtctactattggcgagccccctgtacagcactgggctcagagtcctctctgagacaggctcagtttcagacaacaacccgctggaatgcacagtctcagcaggagagccaggccagagccagcaagaggagactcggtgacaccagtctcctgtagggacaggaggattttgtgggggttcgtgtcactgtgagcatattgtggtggtgactgctgtgtctactattggcggtcgacggtacttcgatctctggggccgtggcaccctggtcactgtctcctcaggtgagtcccactgcagccccctcccagtcttctctgtccaggcaccaggccagtgtctactattggcgctgatggcgcgagggaggc

SEQ ID NO: 5642 - DNA, 396 bp, Artificial Sequence
  source: /note="Description of Artificial Sequence: Synthetic polynucleotide"
gccttgccagcccgctcagtgctacactattggcggtgggcacggacactgtccacctaagccaggggcagacccgagtgtccccgcagtagacctgagagcgctgggcccacagcctcccctcggtgccctgctacctcctcaggtcagccctggacatcccgggtttccccaggctggcggtaggtttggggtgaggtctgtgtcactgtggtattacgatttttggagtggttatttgctacactattggcggtcgacggtacttcgatctctggggccgtggcaccctggtcactgtctcctcaggtgagtcccactgcagccccctcccagtcttctctgtccaggcaccaggccatgctacactattggcgctgatggcgcgagggaggc

SEQ ID NO: 5643 - DNA, 396 bp, Artificial Sequence
  source: /note="Description of Artificial Sequence: Synthetic polynucleotide"
gccttgccagcccgctcagaactgccatattggcgtgggcacggacactatccacataagcgagggatagacccgagtgtccccacagcagacctgagagcgctgggcccacagcctcccctcagagccctgctgcctcctccggtcagccctggacatcccaggtttccccaggcctgccggtaggtttagaatgaggtctgtgtcactgtggtattacgatattttgactggttattaactgccatattggcggtcgacggtacttcgatctctggggccgtggcaccctggtcactgtctcctcaggtgagtcccactgcagccccctcccagtcttctctgtccaggcaccaggccaaactgccatattggcgctgatggcgcgagggaggc

SEQ ID NO: 5644 - DNA, 396 bp, Artificial Sequence
  source: /note="Description of Artificial Sequence: Synthetic polynucleotide"
gccttgccagcccgctcagttggactgtattggcgcgatattttgactggttattataaccacagtgtcacagagtccatcaaaaacccatgcctggaagcttcccgccacagccctccccatggggccctgctgcctcctcaggtcagccccggacatcccgggtttccccaggctgggcggtaggtttggggtgaggtctgtgtcactgtggtattactatggttcggggagttattttggactgtattggcggtcgacggtacttcgatctctggggccgtggcaccctggtcactgtctcctcaggtgagtcccactgcagccccctcccagtcttctctgtccaggcaccaggccattggactgtattggcgctgatggcgcgagggaggc

SEQ ID NO: 5645 - DNA, 402 bp, Artificial Sequence
  source: /note="Description of Artificial Sequence: Synthetic polynucleotide"
gccttgccagcccgctcaggtagacactattggcgtggacgcggacactatccacataagcgagggacagacccgagtgttcctgcagtagacctgagagcgctgggcccacagcctcccctcggtgccctgctgcctcctcaggtcagccctggacatcccgggtttccccaggccagatggtaggtttgaagtgaggtctgtgtcactgtggtattatgattacgtttgggggagttatcgttgtagacactattggcggtcgacggtacttcgatctctggggccgtggcaccctggtcactgtctcctcaggtgagtcccactgcagccccctcccagtcttctctgtccaggcaccaggccagtagacactattggcgctgatggcgcgagggaggc

SEQ ID NO: 5646 - DNA, 396 bp, Artificial Sequence
  source: /note="Description of Artificial Sequence: Synthetic polynucleotide"
gccttgccagcccgctcagcactgtactattggcgtgggcatggacagtgtccacctaagcgagggacagacccgagtgtccctgcagtagacctgagagcgctgggcccacagcctcccctcggggccctgctgcctcctcaggtcagccctggacatcccgggtttccccaggcctggcggtaggtttgaagtgaggtctgtgtcactgtggtattactatgatagtagtggttattcactgtactattggcggtcgacggtacttcgatctctggggccgtggcaccctggtcactgtctcctcaggtgagtcccactgcagccccctcccagtcttctctgtccaggcaccaggccacactgtactattggcgctgatggcgcgagggaggc

SEQ ID NO: 5647 - DNA, 381 bp, Artificial Sequence
  source: /note="Description of Artificial Sequence: Synthetic polynucleotide"
gccttgccagcccgctcaggatgatcctattggcgcaagggtgagtcagaccctcctgccctcgatggcaggcggagaagattcagaaaggtctgagatccccaggacgcagcaccactgtcaatgggggccccagacgcctggaccagggcctgcgtgggaaaggcctctgggcacactcaggggctttttgtgaagggtcctcctactgtgtgactacagtagatgatcctattggcggtcgacggtacttcgatctctggggccgtggcaccctggtcactgtctcctcaggtgagtcccactgcagccccctcccagtcttctctgtccaggcaccaggccagatgatcctattggcgctgatggcgcgagggaggc

SEQ ID NO: 5648 - DNA, 381 bp, Artificial Sequence
  source: /note="Description of Artificial Sequence: Synthetic polynucleotide"
gccttgccagcccgctcagcgccaatatattggcgtgcctctctccccagtggacaccctcttccaggacagtcctcagtggcatcacagcggcctgagatccccaggacgcagcaccgctgtcaataggggccccaaatgcctggaccagggcctgcgtgggaaaggtctctggccacactcgggctttttgtgaagggccctcctgctgtgtgactacagtacgccaatatattggcggtcgacggtacttcgatctctggggccgtggcaccctggtcactgtctcctcaggtgagtcccactgcagccccctcccagtcttctctgtccaggcaccaggccacgccaatatattggcgctgatggcgcgagggaggc

SEQ ID NO: 5649 - DNA, 381 bp, Artificial Sequence
  source: /note="Description of Artificial Sequence: Synthetic polynucleotide"
gccttgccagcccgctcagtcaagccttattggcgggagggtgagtcagacccacctgccctcgatggcaggcggggaagattcagaaaggcctgagatccccaggacgcagcaccactgtcaatgggggccccagacgcctggaccagggcctgcgtgggaaaggccgctgggcacactcaggggctttttgtgaaggcccctcctactgtgtgactacggtgtcaagccttattggcggtcgacggtacttcgatctctggggccgtggcaccctggtcactgtctcctcaggtgagtcccactgcagccccctcccagtcttctctgtccaggcaccaggccatcaagccttattggcgctgatggcgcgagggaggc

SEQ ID NO: 5650 - DNA, 384 bp, Artificial Sequence
  source: /note="Description of Artificial Sequence: Synthetic polynucleotide"
gccttgccagcccgctcagacgtgtgttattggcgggagggtgagtcagacccacctgccctcaatggcaggcggggaagattcagaaaggcctgagatccccaggacgcagcaccactgtcaatgggggccccagacgcctggaccagggcctgtgtgggaaaggcctctggccacactcaggggctttttgtgaagggccctcctgctgtgtgactacggtggtaacgtgtgttattggcggtcgacggtacttcgatctctggggccgtggcaccctggtcactgtctcctcaggtgagtcccactgcagccccctcccagtcttctctgtccaggcaccaggccaacgtgtgttattggcgctgatggcgcgagggaggc

SEQ ID NO: 5651 - DNA, 385 bp, Artificial Sequence
  source: /note="Description of Artificial Sequence: Synthetic polynucleotide"
gccttgccagcccgctcagtccgtctatattggcgagaggcctctccagggggacactgtgcatgtctggtccctgagcagccccccatgtccccagtcctggggggccccctggcacagctgtctggaccctctctattccctgggaagctcctcctgacagccccgcctccagttccaggtgtggttattgtcagggggtgtcagactgtggtggatacagctatgtccgtctatattggcggtcgacggtacttcgatctctggggccgtggcaccctggtcactgtctcctcaggtgagtcccactgcagccccctcccagtcttctctgtccaggcaccaggccatccgtctatattggcgctgatggcgcgagggaggc

SEQ ID NO: 5652 - DNA, 388 bp, Artificial Sequence
  source: /note="Description of Artificial Sequence: Synthetic polynucleotide"
gccttgccagcccgctcagaagagctgtattggcggcagaggcctctccagggagacactgtgcatgtctggtacctaagcagccccccacgtccccagtcctgggggcccctggctcagctgtctggaccctccctgttccctgggaagctcctcctgacagccccgcctccagttccaggtgtggttattgtcaggcgatgtcagactgtggtggatatagtggctacgaagagctgtattggcggtcgacggtacttcgatctctggggccgtggcaccctggtcactgtctcctcaggtgagtcccactgcagccccctcccagtcttctctgtccaggcaccaggccaaagagctgtattggcgctgatggcgcgagggaggc

SEQ ID NO: 5653 - DNA, 385 bp, Artificial Sequence
  source: /note="Description of Artificial Sequence: Synthetic polynucleotide"
gccttgccagcccgctcagtatcgctctattggcggcagaggcctctccagggggacactgtgcatgtctggtccctgagcagccccccacgtccccagtcctgggggcccctggcacagctgtctggaccctccctgttccctgggaagctcctcctgacagccccgcctccagttccaggtgtggttattgtcagggggtgtcagactgtggtggatacagctatgtatcgctctattggcggtcgacggtacttcgatctctggggccgtggcaccctggtcactgtctcctcaggtgagtcccactgcagccccctcccagtcttctctgtccaggcaccaggccatatcgctctattggcgctgatggcgcgagggaggc

SEQ ID NO: 5654 - DNA, 385 bp, Artificial Sequence
  source: /note="Description of Artificial Sequence: Synthetic polynucleotide"
gccttgccagcccgctcagtcagatgctattggcggcagaggcctctccagggggacacagtgcatgtctggtccctgagcagcccccaggctctctagcactgggggcccctggcacagctgtctggaccctccctgttccctgggaagctcctcctgacagccccgcctccagttccaggtgtggttattgtcagggggtgccaggccgtggtagagatggctacatcagatgctattggcggtcgacggtacttcgatctctggggccgtggcaccctggtcactgtctcctcaggtgagtcccactgcagccccctcccagtcttctctgtccaggcaccaggccatcagatgctattggcgctgatggcgcgagggaggc

SEQ ID NO: 5655 - DNA, 383 bp, Artificial Sequence
  source: /note="Description of Artificial Sequence: Synthetic polynucleotide"
gccttgccagcccgctcaggtgtagcatattggcgaggcagctgactcctgacttggacgcctattccagacaccagacagaggggcaggccccccagaaccagggatgaggacgccccgtcaaggccagaaaagaccaagttgtgctgagcccagcaagggaaggtccccaaacaaaccaggaacgtttctgaaggtgtctgtgtcacagtggagtatagcagctgtgtagcatattggcggtcgacggtacttcgatctctggggccgtggcaccctggtcactgtctcctcaggtgagtcccactgcagccccctcccagtcttctctgtccaggcaccaggccagtgtagcatattggcgctgatggcgcgagggaggc

SEQ ID NO: 5656 - DNA, 386 bp, Artificial Sequence
  source: /note="Description of Artificial Sequence: Synthetic polynucleotide"
gccttgccagcccgctcagtggcagtttattggcgaggcagctgacccctgacttggacccctattccagacaccagacagaggcgcaggccccccagaaccagggttgagggacgccccgtcaaagccagacaaaaccaaggggtgttgagcccagcaagggaaggcccccaaacagaccaggaggtttctgaaggtgtctgtgtcacagtggggtatagcagcagcttggcagtttattggcggtcgacggtacttcgatctctggggccgtggcaccctggtcactgtctcctcaggtgagtcccactgcagccccctcccagtcttctctgtccaggcaccaggccatggcagtttattggcgctgatggcgcgagggaggc

SEQ ID NO: 5657 - DNA, 386 bp, Artificial Sequence
  source: /note="Description of Artificial Sequence: Synthetic polynucleotide"
gccttgccagcccgctcagcagtccaatattggcgtgaggtagctggcctctgtctcggaccccactccagacaccagacagaggggcaggccccccaaaaccagggttgagggatgatccgtcaaggcagacaagaccaaggggcactgaccccagcaagggaaggctcccaaacagacgaggaggtttctgaagctgtctgtatcacagtggggtatagcagtggctcagtccaatattggcggtcgacggtacttcgatctctggggccgtggcaccctggtcactgtctcctcaggtgagtcccactgcagccccctcccagtcttctctgtccaggcaccaggccacagtccaatattggcgctgatggcgcgagggaggc

SEQ ID NO: 5658 - DNA, 383 bp, Artificial Sequence
  source: /note="Description of Artificial Sequence: Synthetic polynucleotide"
gccttgccagcccgctcagtacgtacgtattggcgcagctggcctctgtctcggacccccattccagacaccagacagagggacaggccccccagaaccagtgttgagggacacccctgtccagggcagccaagtccaagaggcgcgctgagcccagcaagggaaggcccccaaacaaaccaggaggtttctgaagctgtctgtgtcacagtcgggtatagcagcgtacgtacgtattggcggtcgacggtacttcgatctctggggccgtggcaccctggtcactgtctcctcaggtgagtcccactgcagccccctcccagtcttctctgtccaggcaccaggccatacgtacgtattggcgctgatggcgcgagggaggc

SEQ ID NO: 5659 - DNA, 377 bp, Artificial Sequence
  source: /note="Description of Artificial Sequence: Synthetic polynucleotide"
gccttgccagcccgctcagagtaccgatattggcgagggttgagggctggggtctcccacgtgttttggggctaacagcggaagggagagcactggcaaaggtgctgggggtcccctgaacccgacccgccctgagaccgcagccacatcagcccccagccccacaggccccctaccagccgcagggtttttggctgagctgagaaccactgtgctaactagtaccgatattggcggtcgacggtacttcgatctctggggccgtggcaccctggtcactgtctcctcaggtgagtcccactgcagccccctcccagtcttctctgtccaggcaccaggccaagtaccgatattggcgctgatggcgcgagggaggc

SEQ ID NO: 5660 - DNA, 382 bp, Artificial Sequence
  source: /note="Description of Artificial Sequence: Synthetic polynucleotide"
gccttgccagcccgctcaggacactctaggcttgagccccggtctctgtgggtgttccgctaactggggctcccagtgctcaccccacaactaaagcgagccccagcctccagagcccccgaaggagatgccgcccacaagcccagcccccatccaggaggccccagagctcagggcgccggggcagattctgaacagccccgagtcacggtgggtacaactggagacactctaggcttgagtcgacaagtgcttggagcactggggccagggcagcccggccaccgtctccctgggaacgtcacccctccctgcctgggtctcagcccgggggtctgtgtggctgggacactctaggcttgactgatggcgcgagggaggc

SEQ ID NO: 5661 - DNA, 382 bp, Artificial Sequence
  source: /note="Description of Artificial Sequence: Synthetic polynucleotide"
gccttgccagcccgctcagttcggaacaggcttgaggcctcggtctctgtgggtgttccgctagctggggctcacagtgctcaccccacacctaaaacgagccacagcctcagagcccctgaaggagaccccgcccacaagcccagcccccacccaggaggccccagagcacagggcgccccgtcggattctgaacagccccgagtcacagtgggtataactggattcggaacaggcttgagtcgacaagtgcttggagcactggggccagggcagcccggccaccgtctccctgggaacgtcacccctccctgcctgggtctcagcccgggggtctgtgtggctggttcggaacaggcttgactgatggcgcgagggaggc

SEQ ID NO: 5662 - DNA, 382 bp, Artificial Sequence
  source: /note="Description of Artificial Sequence: Synthetic polynucleotide"
gccttgccagcccgctcagaagtaacgaggcttgaggcctcggtctctgtgggtgttccgctagctggggctcacagtgctcaccccacacctaaaatgagccacagcctccggagcccccgcagagaccccgcccacaagcccagcccccacccaggaggccccagagctcagggcgccccgtcggattccgaacagccccgagtcacagcgggtataaccggaaagtaacgaggcttgagtcgacaagtgcttggagcactggggccagggcagcccggccaccgtctccctgggaacgtcacccctccctgcctgggtctcagcccgggggtctgtgtggctggaagtaacgaggcttgactgatggcgcgagggaggc

SEQ ID NO: 5663 - DNA, 382 bp, Artificial Sequence
  source: /note="Description of Artificial Sequence: Synthetic polynucleotide"
gccttgccagcccgctcaggtctcctaaggcttgagtctctgtgggtgttccgctagctggggcccccagtgctcaccccacacctaaagcgagccccagcctccagagccccctaagcattccccgcccagcagcccagcccctgcccccacccaggaggccccagagctcagggcgcctggtcggattctgaacagccccgagtcacagtgggtataactggagtctcctaaggcttgagtcgacaagtgcttggagcactggggccagggcagcccggccaccgtctccctgggaacgtcacccctccctgcctgggtctcagcccgggggtctgtgtggctgggtctcctaaggcttgactgatggcgcgagggaggc

SEQ ID NO: 5664 - DNA, 385 bp, Artificial Sequence
  source: /note="Description of Artificial Sequence: Synthetic polynucleotide"
gccttgccagcccgctcagagagtgtcaggcttgaaggcctcaggctctgtgggtgccgctagctggggctgccagtcctcaccccacacctaaggtgagccacagccgccagagcctccacaggagaccccacccagcagcccagcccctacccaggaggccccagagctcagggcgcctgggtggattctgaacagccccgagtcacggtgggtatagtgggagctagagtgtcaggcttgagtcgacaagtgcttggagcactggggccagggcagcccggccaccgtctccctgggaacgtcacccctccctgcctgggtctcagcccgggggtctgtgtggctggagagtgtcaggcttgactgatggcgcgagggaggc

SEQ ID NO: 5665 - DNA, 396 bp, Artificial Sequence
  source: /note="Description of Artificial Sequence: Synthetic polynucleotide"
gccttgccagcccgctcaggttccgaaaggcttgaaaaggaggagccccctgtacagcactgggctcagagtcctctcccacacaccctgagtttcagacaaaaaccccctggaaatcatagtatcagcaggagaactagccagagacagcaagaggggactcagtgactcccgcggggacaggaggattttgtgggggctcgtgtcactgtgaggatattgtagtagtaccagctgctgttccgaaaggcttgagtcgacaagtgcttggagcactggggccagggcagcccggccaccgtctccctgggaacgtcacccctccctgcctgggtctcagcccgggggtctgtgtggctgggttccgaaaggcttgactgatggcgcgagggaggc

SEQ ID NO: 5666 - DNA, 396 bp, Artificial Sequence
  source: /note="Description of Artificial Sequence: Synthetic polynucleotide"
gccttgccagcccgctcagcgttacttaggcttgaaaaggaggagccccttgttcagcactgggctcagagtcctctccaagacacccagagtttcagacaaaaaccccctggaatgcacagtctcagcaggagagccagccagagccagcaagatggggctcagtgacacccgcagggacaggaggattttgtgggggctcgtgtcactgtgaggatattgtactaatggtgtatgctcgttacttaggcttgagtcgacaagtgcttggagcactggggccagggcagcccggccaccgtctccctgggaacgtcacccctccctgcctgggtctcagcccgggggtctgtgtggctggcgttacttaggcttgactgatggcgcgagggaggc

SEQ ID NO: 5667 - DNA, 396 bp, Artificial Sequence
  source: /note="Description of Artificial Sequence: Synthetic polynucleotide"
gccttgccagcccgctcagtaggagacaggcttgaaaaggaggagccccctatacagcactgggctcagagtcctctctgagacaccctgagtttcagacaacaacccgctggaatgcacagtctcagcaggagaacagaccaaagccagcaaaagggacctcggtgacaccagtagggacaggaggattttgtgggggctcgtgtcactgtgaggatattgtagtggtggtagctgcttaggagacaggcttgagtcgacaagtgcttggagcactggggccagggcagcccggccaccgtctccctgggaacgtcacccctccctgcctgggtctcagcccgggggtctgtgtggctggtaggagacaggcttgactgatggcgcgagggaggc

SEQ ID NO: 5668 - DNA, 393 bp, Artificial Sequence
  source: /note="Description of Artificial Sequence: Synthetic polynucleotide"
gccttgccagcccgctcaggtgtctacaggcttgaagccccctgtacagcactgggctcagagtcctctctgagacaggctcagtttcagacaacaacccgctggaatgcacagtctcagcaggagagccaggccagagccagcaagaggagactcggtgacaccagtctcctgtagggacaggaggattttgtgggggttcgtgtcactgtgagcatattgtggtggtgactgctgtgtctacaggcttgagtcgacaagtgcttggagcactggggccagggcagcccggccaccgtctccctgggaacgtcacccctccctgcctgggtctcagcccgggggtctgtgtggctgggtgtctacaggcttgactgatggcgcgagggaggc

SEQ ID NO: 5669 - DNA, 396 bp, Artificial Sequence
  source: /note="Description of Artificial Sequence: Synthetic polynucleotide"
gccttgccagcccgctcagtgctacacaggcttgagtgggcacggacactgtccacctaagccaggggcagacccgagtgtccccgcagtagacctgagagcgctgggcccacagcctcccctcggtgccctgctacctcctcaggtcagccctggacatcccgggtttccccaggctggcggtaggtttggggtgaggtctgtgtcactgtggtattacgatttttggagtggttatttgctacacaggcttgagtcgacaagtgcttggagcactggggccagggcagcccggccaccgtctccctgggaacgtcacccctccctgcctgggtctcagcccgggggtctgtgtggctggtgctacacaggcttgactgatggcgcgagggaggc

SEQ ID NO: 5670 - DNA, 396 bp, Artificial Sequence
  source: /note="Description of Artificial Sequence: Synthetic polynucleotide"
gccttgccagcccgctcagaactgccaaggcttgatgggcacggacactatccacataagcgagggatagacccgagtgtccccacagcagacctgagagcgctgggcccacagcctcccctcagagccctgctgcctcctccggtcagccctggacatcccaggtttccccaggcctgccggtaggtttagaatgaggtctgtgtcactgtggtattacgatattttgactggttattaactgccaaggcttgagtcgacaagtgcttggagcactggggccagggcagcccggccaccgtctccctgggaacgtcacccctccctgcctgggtctcagcccgggggtctgtgtggctggaactgccaaggcttgactgatggcgcgagggaggc

SEQ ID NO: 5671 - DNA, 396 bp, Artificial Sequence
  source: /note="Description of Artificial Sequence: Synthetic polynucleotide"
gccttgccagcccgctcagttggactgaggcttgacgatattttgactggttattataaccacagtgtcacagagtccatcaaaaacccatgcctggaagcttcccgccacagccctccccatggggccctgctgcctcctcaggtcagccccggacatcccgggtttccccaggctgggcggtaggtttggggtgaggtctgtgtcactgtggtattactatggttcggggagttattttggactgaggcttgagtcgacaagtgcttggagcactggggccagggcagcccggccaccgtctccctgggaacgtcacccctccctgcctgggtctcagcccgggggtctgtgtggctggttggactgaggcttgactgatggcgcgagggaggc

SEQ ID NO: 5672 - DNA, 402 bp, Artificial Sequence
  source: /note="Description of Artificial Sequence: Synthetic polynucleotide"
gccttgccagcccgctcaggtagacacaggcttgatggacgcggacactatccacataagcgagggacagacccgagtgttcctgcagtagacctgagagcgctgggcccacagcctcccctcggtgccctgctgcctcctcaggtcagccctggacatcccgggtttccccaggccagatggtaggtttgaagtgaggtctgtgtcactgtggtattatgattacgtttgggggagttatcgttgtagacacaggcttgagtcgacaagtgcttggagcactggggccagggcagcccggccaccgtctccctgggaacgtcacccctccctgcctgggtctcagcccgggggtctgtgtggctgggtagacacaggcttgactgatggcgcgagggaggc

SEQ ID NO: 5673 - DNA, 396 bp, Artificial Sequence
  source: /note="Description of Artificial Sequence: Synthetic polynucleotide"
gccttgccagcccgctcagcactgtacaggcttgatgggcatggacagtgtccacctaagcgagggacagacccgagtgtccctgcagtagacctgagagcgctgggcccacagcctcccctcggggccctgctgcctcctcaggtcagccctggacatcccgggtttccccaggcctggcggtaggtttgaagtgaggtctgtgtcactgtggtattactatgatagtagtggttattcactgtacaggcttgagtcgacaagtgcttggagcactggggccagggcagcccggccaccgtctccctgggaacgtcacccctccctgcctgggtctcagcccgggggtctgtgtggctggcactgtacaggcttgactgatggcgcgagggaggc

SEQ ID NO: 5674 - DNA, 381 bp, Artificial Sequence
  source: /note="Description of Artificial Sequence: Synthetic polynucleotide"
gccttgccagcccgctcaggatgatccaggcttgacaagggtgagtcagaccctcctgccctcgatggcaggcggagaagattcagaaaggtctgagatccccaggacgcagcaccactgtcaatgggggccccagacgcctggaccagggcctgcgtgggaaaggcctctgggcacactcaggggctttttgtgaagggtcctcctactgtgtgactacagtagatgatccaggcttgagtcgacaagtgcttggagcactggggccagggcagcccggccaccgtctccctgggaacgtcacccctccctgcctgggtctcagcccgggggtctgtgtggctgggatgatccaggcttgactgatggcgcgagggaggc

SEQ ID NO: 5675 - DNA, 381 bp, Artificial Sequence
  source: /note="Description of Artificial Sequence: Synthetic polynucleotide"
gccttgccagcccgctcagcgccaataaggcttgatgcctctctccccagtggacaccctcttccaggacagtcctcagtggcatcacagcggcctgagatccccaggacgcagcaccgctgtcaataggggccccaaatgcctggaccagggcctgcgtgggaaaggtctctggccacactcgggctttttgtgaagggccctcctgctgtgtgactacagtacgccaataaggcttgagtcgacaagtgcttggagcactggggccagggcagcccggccaccgtctccctgggaacgtcacccctccctgcctgggtctcagcccgggggtctgtgtggctggcgccaataaggcttgactgatggcgcgagggaggc

SEQ ID NO: 5676 - DNA, 381 bp, Artificial Sequence
  source: /note="Description of Artificial Sequence: Synthetic polynucleotide"
gccttgccagcccgctcagtcaagcctaggcttgaggagggtgagtcagacccacctgccctcgatggcaggcggggaagattcagaaaggcctgagatccccaggacgcagcaccactgtcaatgggggccccagacgcctggaccagggcctgcgtgggaaaggccgctgggcacactcaggggctttttgtgaaggcccctcctactgtgtgactacggtgtcaagcctaggcttgagtcgacaagtgcttggagcactggggccagggcagcccggccaccgtctccctgggaacgtcacccctccctgcctgggtctcagcccgggggtctgtgtggctggtcaagcctaggcttgactgatggcgcgagggaggc

SEQ ID NO: 5677 - DNA, 384 bp, Artificial Sequence
  source: /note="Description of Artificial Sequence: Synthetic polynucleotide"
gccttgccagcccgctcagacgtgtgtaggcttgaggagggtgagtcagacccacctgccctcaatggcaggcggggaagattcagaaaggcctgagatccccaggacgcagcaccactgtcaatgggggccccagacgcctggaccagggcctgtgtgggaaaggcctctggccacactcaggggctttttgtgaagggccctcctgctgtgtgactacggtggtaacgtgtgtaggcttgagtcgacaagtgcttggagcactggggccagggcagcccggccaccgtctccctgggaacgtcacccctccctgcctgggtctcagcccgggggtctgtgtggctggacgtgtgtaggcttgactgatggcgcgagggaggc

SEQ ID NO: 5678 - DNA, 385 bp, Artificial Sequence
  source: /note="Description of Artificial Sequence: Synthetic polynucleotide"
gccttgccagcccgctcagtccgtctaaggcttgaagaggcctctccagggggacactgtgcatgtctggtccctgagcagccccccatgtccccagtcctggggggccccctggcacagctgtctggaccctctctattccctgggaagctcctcctgacagccccgcctccagttccaggtgtggttattgtcagggggtgtcagactgtggtggatacagctatgtccgtctaaggcttgagtcgacaagtgcttggagcactggggccagggcagcccggccaccgtctccctgggaacgtcacccctccctgcctgggtctcagcccgggggtctgtgtggctggtccgtctaaggcttgactgatggcgcgagggaggc

SEQ ID NO: 5679 - DNA, 388 bp, Artificial Sequence
  source: /note="Description of Artificial Sequence: Synthetic polynucleotide"
gccttgccagcccgctcagaagagctgaggcttgagcagaggcctctccagggagacactgtgcatgtctggtacctaagcagccccccacgtccccagtcctgggggcccctggctcagctgtctggaccctccctgttccctgggaagctcctcctgacagccccgcctccagttccaggtgtggttattgtcaggcgatgtcagactgtggtggatatagtggctacgaagagctgaggcttgagtcgacaagtgcttggagcactggggccagggcagcccggccaccgtctccctgggaacgtcacccctccctgcctgggtctcagcccgggggtctgtgtggctggaagagctgaggcttgactgatggcgcgagggaggc

SEQ ID NO: 5680 - DNA, 385 bp, Artificial Sequence
  source: /note="Description of Artificial Sequence: Synthetic polynucleotide"
gccttgccagcccgctcagtatcgctcaggcttgagcagaggcctctccagggggacactgtgcatgtctggtccctgagcagccccccacgtccccagtcctgggggcccctggcacagctgtctggaccctccctgttccctgggaagctcctcctgacagccccgcctccagttccaggtgtggttattgtcagggggtgtcagactgtggtggatacagctatgtatcgctcaggcttgagtcgacaagtgcttggagcactggggccagggcagcccggccaccgtctccctgggaacgtcacccctccctgcctgggtctcagcccgggggtctgtgtggctggtatcgctcaggcttgactgatggcgcgagggaggc

SEQ ID NO: 5681 - DNA, 385 bp, Artificial Sequence
  source: /note="Description of Artificial Sequence: Synthetic polynucleotide"
gccttgccagcccgctcagtcagatgcaggcttgagcagaggcctctccagggggacacagtgcatgtctggtccctgagcagcccccaggctctctagcactgggggcccctggcacagctgtctggaccctccctgttccctgggaagctcctcctgacagccccgcctccagttccaggtgtggttattgtcagggggtgccaggccgtggtagagatggctacatcagatgcaggcttgagtcgacaagtgcttggagcactggggccagggcagcccggccaccgtctccctgggaacgtcacccctccctgcctgggtctcagcccgggggtctgtgtggctggtcagatgcaggcttgactgatggcgcgagggaggc

SEQ ID NO: 5682 - DNA, 383 bp, Artificial Sequence
  source: /note="Description of Artificial Sequence: Synthetic polynucleotide"
gccttgccagcccgctcaggtgtagcaaggcttgaaggcagctgactcctgacttggacgcctattccagacaccagacagaggggcaggccccccagaaccagggatgaggacgccccgtcaaggccagaaaagaccaagttgtgctgagcccagcaagggaaggtccccaaacaaaccaggaacgtttctgaaggtgtctgtgtcacagtggagtatagcagctgtgtagcaaggcttgagtcgacaagtgcttggagcactggggccagggcagcccggccaccgtctccctgggaacgtcacccctccctgcctgggtctcagcccgggggtctgtgtggctgggtgtagcaaggcttgactgatggcgcgagggaggc

SEQ ID NO: 5683 - DNA, 386 bp, Artificial Sequence
  source: /note="Description of Artificial Sequence: Synthetic polynucleotide"
gccttgccagcccgctcagtggcagttaggcttgaaggcagctgacccctgacttggacccctattccagacaccagacagaggcgcaggccccccagaaccagggttgagggacgccccgtcaaagccagacaaaaccaaggggtgttgagcccagcaagggaaggcccccaaacagaccaggaggtttctgaaggtgtctgtgtcacagtggggtatagcagcagcttggcagttaggcttgagtcgacaagtgcttggagcactggggccagggcagcccggccaccgtctccctgggaacgtcacccctccctgcctgggtctcagcccgggggtctgtgtggctggtggcagttaggcttgactgatggcgcgagggaggc

SEQ ID NO: 5684 - DNA, 386 bp, Artificial Sequence
  source: /note="Description of Artificial Sequence: Synthetic polynucleotide"
gccttgccagcccgctcagcagtccaaaggcttgatgaggtagctggcctctgtctcggaccccactccagacaccagacagaggggcaggccccccaaaaccagggttgagggatgatccgtcaaggcagacaagaccaaggggcactgaccccagcaagggaaggctcccaaacagacgaggaggtttctgaagctgtctgtatcacagtggggtatagcagtggctcagtccaaaggcttgagtcgacaagtgcttggagcactggggccagggcagcccggccaccgtctccctgggaacgtcacccctccctgcctgggtctcagcccgggggtctgtgtggctggcagtccaaaggcttgactgatggcgcgagggaggc

SEQ ID NO: 5685 - DNA, 383 bp, Artificial Sequence
  source: /note="Description of Artificial Sequence: Synthetic polynucleotide"
gccttgccagcccgctcagtacgtacgaggcttgacagctggcctctgtctcggacccccattccagacaccagacagagggacaggccccccagaaccagtgttgagggacacccctgtccagggcagccaagtccaagaggcgcgctgagcccagcaagggaaggcccccaaacaaaccaggaggtttctgaagctgtctgtgtcacagtcgggtatagcagcgtacgtacgaggcttgagtcgacaagtgcttggagcactggggccagggcagcccggccaccgtctccctgggaacgtcacccctccctgcctgggtctcagcccgggggtctgtgtggctggtacgtacgaggcttgactgatggcgcgagggaggc

SEQ ID NO: 5686 - DNA, 377 bp, Artificial Sequence
  source: /note="Description of Artificial Sequence: Synthetic polynucleotide"
gccttgccagcccgctcagagtaccgaaggcttgaagggttgagggctggggtctcccacgtgttttggggctaacagcggaagggagagcactggcaaaggtgctgggggtcccctgaacccgacccgccctgagaccgcagccacatcagcccccagccccacaggccccctaccagccgcagggtttttggctgagctgagaaccactgtgctaactagtaccgaaggcttgagtcgacaagtgcttggagcactggggccagggcagcccggccaccgtctccctgggaacgtcacccctccctgcctgggtctcagcccgggggtctgtgtggctggagtaccgaaggcttgactgatggcgcgagggaggc

SEQ ID NO: 5687 - DNA, 382 bp, Artificial Sequence
  source: /note="Description of Artificial Sequence: Synthetic polynucleotide"
gccttgccagcccgctcaggacactctacacacgtgccccggtctctgtgggtgttccgctaactggggctcccagtgctcaccccacaactaaagcgagccccagcctccagagcccccgaaggagatgccgcccacaagcccagcccccatccaggaggccccagagctcagggcgccggggcagattctgaacagccccgagtcacggtgggtacaactggagacactctacacacgtgtcgaccttttgatatctggggccaagggacaatggtcaccgtctcttcaggtaagatggctttccttctgcctcctttctctgggcccagcgtcctctgtcctgggacactctacacacgtctgatggcgcgagggaggc

SEQ ID NO: 5688 - DNA, 382 bp, Artificial Sequence
  source: /note="Description of Artificial Sequence: Synthetic polynucleotide"
gccttgccagcccgctcagttcggaacacacacgtggcctcggtctctgtgggtgttccgctagctggggctcacagtgctcaccccacacctaaaacgagccacagcctcagagcccctgaaggagaccccgcccacaagcccagcccccacccaggaggccccagagcacagggcgccccgtcggattctgaacagccccgagtcacagtgggtataactggattcggaacacacacgtgtcgaccttttgatatctggggccaagggacaatggtcaccgtctcttcaggtaagatggctttccttctgcctcctttctctgggcccagcgtcctctgtcctggttcggaacacacacgtctgatggcgcgagggaggc

SEQ ID NO: 5689 - DNA, 382 bp, Artificial Sequence
  source: /note="Description of Artificial Sequence: Synthetic polynucleotide"
gccttgccagcccgctcagaagtaacgacacacgtggcctcggtctctgtgggtgttccgctagctggggctcacagtgctcaccccacacctaaaatgagccacagcctccggagcccccgcagagaccccgcccacaagcccagcccccacccaggaggccccagagctcagggcgccccgtcggattccgaacagccccgagtcacagcgggtataaccggaaagtaacgacacacgtgtcgaccttttgatatctggggccaagggacaatggtcaccgtctcttcaggtaagatggctttccttctgcctcctttctctgggcccagcgtcctctgtcctggaagtaacgacacacgtctgatggcgcgagggaggc

SEQ ID NO: 5690 - DNA, 382 bp, Artificial Sequence
  source: /note="Description of Artificial Sequence: Synthetic polynucleotide"
gccttgccagcccgctcaggtctcctaacacacgtgtctctgtgggtgttccgctagctggggcccccagtgctcaccccacacctaaagcgagccccagcctccagagccccctaagcattccccgcccagcagcccagcccctgcccccacccaggaggccccagagctcagggcgcctggtcggattctgaacagccccgagtcacagtgggtataactggagtctcctaacacacgtgtcgaccttttgatatctggggccaagggacaatggtcaccgtctcttcaggtaagatggctttccttctgcctcctttctctgggcccagcgtcctctgtcctgggtctcctaacacacgtctgatggcgcgagggaggc

SEQ ID NO: 5691 - DNA, 385 bp, Artificial Sequence
  source: /note="Description of Artificial Sequence: Synthetic polynucleotide"
gccttgccagcccgctcagagagtgtcacacacgtaggcctcaggctctgtgggtgccgctagctggggctgccagtcctcaccccacacctaaggtgagccacagccgccagagcctccacaggagaccccacccagcagcccagcccctacccaggaggccccagagctcagggcgcctgggtggattctgaacagccccgagtcacggtgggtatagtgggagctagagtgtcacacacgtgtcgaccttttgatatctggggccaagggacaatggtcaccgtctcttcaggtaagatggctttccttctgcctcctttctctgggcccagcgtcctctgtcctggagagtgtcacacacgtctgatggcgcgagggaggc

SEQ ID NO: 5692 - DNA, 396 bp, Artificial Sequence
  source: /note="Description of Artificial Sequence: Synthetic polynucleotide"
gccttgccagcccgctcaggttccgaaacacacgtaaaggaggagccccctgtacagcactgggctcagagtcctctcccacacaccctgagtttcagacaaaaaccccctggaaatcatagtatcagcaggagaactagccagagacagcaagaggggactcagtgactcccgcggggacaggaggattttgtgggggctcgtgtcactgtgaggatattgtagtagtaccagctgctgttccgaaacacacgtgtcgaccttttgatatctggggccaagggacaatggtcaccgtctcttcaggtaagatggctttccttctgcctcctttctctgggcccagcgtcctctgtcctgggttccgaaacacacgtctgatggcgcgagggaggc

SEQ ID NO: 5693 - DNA, 396 bp, Artificial Sequence
  source: /note="Description of Artificial Sequence: Synthetic polynucleotide"
gccttgccagcccgctcagcgttacttacacacgtaaaggaggagccccttgttcagcactgggctcagagtcctctccaagacacccagagtttcagacaaaaaccccctggaatgcacagtctcagcaggagagccagccagagccagcaagatggggctcagtgacacccgcagggacaggaggattttgtgggggctcgtgtcactgtgaggatattgtactaatggtgtatgctcgttacttacacacgtgtcgaccttttgatatctggggccaagggacaatggtcaccgtctcttcaggtaagatggctttccttctgcctcctttctctgggcccagcgtcctctgtcctggcgttacttacacacgtctgatggcgcgagggaggc

SEQ ID NO: 5694 - DNA, 396 bp, Artificial Sequence
  source: /note="Description of Artificial Sequence: Synthetic polynucleotide"
gccttgccagcccgctcagtaggagacacacacgtaaaggaggagccccctatacagcactgggctcagagtcctctctgagacaccctgagtttcagacaacaacccgctggaatgcacagtctcagcaggagaacagaccaaagccagcaaaagggacctcggtgacaccagtagggacaggaggattttgtgggggctcgtgtcactgtgaggatattgtagtggtggtagctgcttaggagacacacacgtgtcgaccttttgatatctggggccaagggacaatggtcaccgtctcttcaggtaagatggctttccttctgcctcctttctctgggcccagcgtcctctgtcctggtaggagacacacacgtctgatggcgcgagggaggc

SEQ ID NO: 5695 - DNA, 393 bp, Artificial Sequence
  source: /note="Description of Artificial Sequence: Synthetic polynucleotide"
gccttgccagcccgctcaggtgtctacacacacgtagccccctgtacagcactgggctcagagtcctctctgagacaggctcagtttcagacaacaacccgctggaatgcacagtctcagcaggagagccaggccagagccagcaagaggagactcggtgacaccagtctcctgtagggacaggaggattttgtgggggttcgtgtcactgtgagcatattgtggtggtgactgctgtgtctacacacacgtgtcgaccttttgatatctggggccaagggacaatggtcaccgtctcttcaggtaagatggctttccttctgcctcctttctctgggcccagcgtcctctgtcctgggtgtctacacacacgtctgatggcgcgagggaggc

SEQ ID NO: 5696 - DNA, 396 bp, Artificial Sequence
  source: /note="Description of Artificial Sequence: Synthetic polynucleotide"
gccttgccagcccgctcagtgctacacacacacgtgtgggcacggacactgtccacctaagccaggggcagacccgagtgtccccgcagtagacctgagagcgctgggcccacagcctcccctcggtgccctgctacctcctcaggtcagccctggacatcccgggtttccccaggctggcggtaggtttggggtgaggtctgtgtcactgtggtattacgatttttggagtggttatttgctacacacacacgtgtcgaccttttgatatctggggccaagggacaatggtcaccgtctcttcaggtaagatggctttccttctgcctcctttctctgggcccagcgtcctctgtcctggtgctacacacacacgtctgatggcgcgagggaggc

SEQ ID NO: 5697 - DNA, 396 bp, Artificial Sequence
  source: /note="Description of Artificial Sequence: Synthetic polynucleotide"
gccttgccagcccgctcagaactgccaacacacgttgggcacggacactatccacataagcgagggatagacccgagtgtccccacagcagacctgagagcgctgggcccacagcctcccctcagagccctgctgcctcctccggtcagccctggacatcccaggtttccccaggcctgccggtaggtttagaatgaggtctgtgtcactgtggtattacgatattttgactggttattaactgccaacacacgtgtcgaccttttgatatctggggccaagggacaatggtcaccgtctcttcaggtaagatggctttccttctgcctcctttctctgggcccagcgtcctctgtcctggaactgccaacacacgtctgatggcgcgagggaggc

SEQ ID NO: 5698 - DNA, 396 bp, Artificial Sequence
  source: /note="Description of Artificial Sequence: Synthetic polynucleotide"
gccttgccagcccgctcagttggactgacacacgtcgatattttgactggttattataaccacagtgtcacagagtccatcaaaaacccatgcctggaagcttcccgccacagccctccccatggggccctgctgcctcctcaggtcagccccggacatcccgggtttccccaggctgggcggtaggtttggggtgaggtctgtgtcactgtggtattactatggttcggggagttattttggactgacacacgtgtcgaccttttgatatctggggccaagggacaatggtcaccgtctcttcaggtaagatggctttccttctgcctcctttctctgggcccagcgtcctctgtcctggttggactgacacacgtctgatggcgcgagggaggc

SEQ ID NO: 5699 - DNA, 402 bp, Artificial Sequence
  source: /note="Description of Artificial Sequence: Synthetic polynucleotide"
gccttgccagcccgctcaggtagacacacacacgttggacgcggacactatccacataagcgagggacagacccgagtgttcctgcagtagacctgagagcgctgggcccacagcctcccctcggtgccctgctgcctcctcaggtcagccctggacatcccgggtttccccaggccagatggtaggtttgaagtgaggtctgtgtcactgtggtattatgattacgtttgggggagttatcgttgtagacacacacacgtgtcgaccttttgatatctggggccaagggacaatggtcaccgtctcttcaggtaagatggctttccttctgcctcctttctctgggcccagcgtcctctgtcctgggtagacacacacacgtctgatggcgcgagggaggc

SEQ ID NO: 5700 - DNA, 396 bp, Artificial Sequence
  source: /note="Description of Artificial Sequence: Synthetic polynucleotide"
gccttgccagcccgctcagcactgtacacacacgttgggcatggacagtgtccacctaagcgagggacagacccgagtgtccctgcagtagacctgagagcgctgggcccacagcctcccctcggggccctgctgcctcctcaggtcagccctggacatcccgggtttccccaggcctggcggtaggtttgaagtgaggtctgtgtcactgtggtattactatgatagtagtggttattcactgtacacacacgtgtcgaccttttgatatctggggccaagggacaatggtcaccgtctcttcaggtaagatggctttccttctgcctcctttctctgggcccagcgtcctctgtcctggcactgtacacacacgtctgatggcgcgagggaggc

SEQ ID NO: 5701 - DNA, 381 bp, Artificial Sequence
  source: /note="Description of Artificial Sequence: Synthetic polynucleotide"
gccttgccagcccgctcaggatgatccacacacgtcaagggtgagtcagaccctcctgccctcgatggcaggcggagaagattcagaaaggtctgagatccccaggacgcagcaccactgtcaatgggggccccagacgcctggaccagggcctgcgtgggaaaggcctctgggcacactcaggggctttttgtgaagggtcctcctactgtgtgactacagtagatgatccacacacgtgtcgaccttttgatatctggggccaagggacaatggtcaccgtctcttcaggtaagatggctttccttctgcctcctttctctgggcccagcgtcctctgtcctgggatgatccacacacgtctgatggcgcgagggaggc

SEQ ID NO: 5702 - DNA, 381 bp, Artificial Sequence
  source: /note="Description of Artificial Sequence: Synthetic polynucleotide"
gccttgccagcccgctcagcgccaataacacacgttgcctctctccccagtggacaccctcttccaggacagtcctcagtggcatcacagcggcctgagatccccaggacgcagcaccgctgtcaataggggccccaaatgcctggaccagggcctgcgtgggaaaggtctctggccacactcgggctttttgtgaagggccctcctgctgtgtgactacagtacgccaataacacacgtgtcgaccttttgatatctggggccaagggacaatggtcaccgtctcttcaggtaagatggctttccttctgcctcctttctctgggcccagcgtcctctgtcctggcgccaataacacacgtctgatggcgcgagggaggc

SEQ ID NO: 5703 - DNA, 381 bp, Artificial Sequence
  source: /note="Description of Artificial Sequence: Synthetic polynucleotide"
gccttgccagcccgctcagtcaagcctacacacgtggagggtgagtcagacccacctgccctcgatggcaggcggggaagattcagaaaggcctgagatccccaggacgcagcaccactgtcaatgggggccccagacgcctggaccagggcctgcgtgggaaaggccgctgggcacactcaggggctttttgtgaaggcccctcctactgtgtgactacggtgtcaagcctacacacgtgtcgaccttttgatatctggggccaagggacaatggtcaccgtctcttcaggtaagatggctttccttctgcctcctttctctgggcccagcgtcctctgtcctggtcaagcctacacacgtctgatggcgcgagggaggc

SEQ ID NO: 5704 - DNA, 384 bp, Artificial Sequence
  source: /note="Description of Artificial Sequence: Synthetic polynucleotide"
gccttgccagcccgctcagacgtgtgtacacacgtggagggtgagtcagacccacctgccctcaatggcaggcggggaagattcagaaaggcctgagatccccaggacgcagcaccactgtcaatgggggccccagacgcctggaccagggcctgtgtgggaaaggcctctggccacactcaggggctttttgtgaagggccctcctgctgtgtgactacggtggtaacgtgtgtacacacgtgtcgaccttttgatatctggggccaagggacaatggtcaccgtctcttcaggtaagatggctttccttctgcctcctttctctgggcccagcgtcctctgtcctggacgtgtgtacacacgtctgatggcgcgagggaggc

SEQ ID NO: 5705 - DNA, 385 bp, Artificial Sequence
  source: /note="Description of Artificial Sequence: Synthetic polynucleotide"
gccttgccagcccgctcagtccgtctaacacacgtagaggcctctccagggggacactgtgcatgtctggtccctgagcagccccccatgtccccagtcctggggggccccctggcacagctgtctggaccctctctattccctgggaagctcctcctgacagccccgcctccagttccaggtgtggttattgtcagggggtgtcagactgtggtggatacagctatgtccgtctaacacacgtgtcgaccttttgatatctggggccaagggacaatggtcaccgtctcttcaggtaagatggctttccttctgcctcctttctctgggcccagcgtcctctgtcctggtccgtctaacacacgtctgatggcgcgagggaggc

SEQ ID NO: 5706 - DNA, 388 bp, Artificial Sequence
  source: /note="Description of Artificial Sequence: Synthetic polynucleotide"
gccttgccagcccgctcagaagagctgacacacgtgcagaggcctctccagggagacactgtgcatgtctggtacctaagcagccccccacgtccccagtcctgggggcccctggctcagctgtctggaccctccctgttccctgggaagctcctcctgacagccccgcctccagttccaggtgtggttattgtcaggcgatgtcagactgtggtggatatagtggctacgaagagctgacacacgtgtcgaccttttgatatctggggccaagggacaatggtcaccgtctcttcaggtaagatggctttccttctgcctcctttctctgggcccagcgtcctctgtcctggaagagctgacacacgtctgatggcgcgagggaggc

SEQ ID NO: 5707 - DNA, 385 bp, Artificial Sequence
  source: /note="Description of Artificial Sequence: Synthetic polynucleotide"
gccttgccagcccgctcagtatcgctcacacacgtgcagaggcctctccagggggacactgtgcatgtctggtccctgagcagccccccacgtccccagtcctgggggcccctggcacagctgtctggaccctccctgttccctgggaagctcctcctgacagccccgcctccagttccaggtgtggttattgtcagggggtgtcagactgtggtggatacagctatgtatcgctcacacacgtgtcgaccttttgatatctggggccaagggacaatggtcaccgtctcttcaggtaagatggctttccttctgcctcctttctctgggcccagcgtcctctgtcctggtatcgctcacacacgtctgatggcgcgagggaggc

SEQ ID NO: 5708 - DNA, 385 bp, Artificial Sequence
  source: /note="Description of Artificial Sequence: Synthetic polynucleotide"
gccttgccagcccgctcagtcagatgcacacacgtgcagaggcctctccagggggacacagtgcatgtctggtccctgagcagcccccaggctctctagcactgggggcccctggcacagctgtctggaccctccctgttccctgggaagctcctcctgacagccccgcctccagttccaggtgtggttattgtcagggggtgccaggccgtggtagagatggctacatcagatgcacacacgtgtcgaccttttgatatctggggccaagggacaatggtcaccgtctcttcaggtaagatggctttccttctgcctcctttctctgggcccagcgtcctctgtcctggtcagatgcacacacgtctgatggcgcgagggaggc

SEQ ID NO: 5709 - DNA, 383 bp, Artificial Sequence
  source: /note="Description of Artificial Sequence: Synthetic polynucleotide"
gccttgccagcccgctcaggtgtagcaacacacgtaggcagctgactcctgacttggacgcctattccagacaccagacagaggggcaggccccccagaaccagggatgaggacgccccgtcaaggccagaaaagaccaagttgtgctgagcccagcaagggaaggtccccaaacaaaccaggaacgtttctgaaggtgtctgtgtcacagtggagtatagcagctgtgtagcaacacacgtgtcgaccttttgatatctggggccaagggacaatggtcaccgtctcttcaggtaagatggctttccttctgcctcctttctctgggcccagcgtcctctgtcctgggtgtagcaacacacgtctgatggcgcgagggaggc

SEQ ID NO: 5710 - DNA, 386 bp, Artificial Sequence
  source: /note="Description of Artificial Sequence: Synthetic polynucleotide"
gccttgccagcccgctcagtggcagttacacacgtaggcagctgacccctgacttggacccctattccagacaccagacagaggcgcaggccccccagaaccagggttgagggacgccccgtcaaagccagacaaaaccaaggggtgttgagcccagcaagggaaggcccccaaacagaccaggaggtttctgaaggtgtctgtgtcacagtggggtatagcagcagcttggcagttacacacgtgtcgaccttttgatatctggggccaagggacaatggtcaccgtctcttcaggtaagatggctttccttctgcctcctttctctgggcccagcgtcctctgtcctggtggcagttacacacgtctgatggcgcgagggaggc

SEQ ID NO: 5711 - DNA, 386 bp, Artificial Sequence
  source: /note="Description of Artificial Sequence: Synthetic polynucleotide"
gccttgccagcccgctcagcagtccaaacacacgttgaggtagctggcctctgtctcggaccccactccagacaccagacagaggggcaggccccccaaaaccagggttgagggatgatccgtcaaggcagacaagaccaaggggcactgaccccagcaagggaaggctcccaaacagacgaggaggtttctgaagctgtctgtatcacagtggggtatagcagtggctcagtccaaacacacgtgtcgaccttttgatatctggggccaagggacaatggtcaccgtctcttcaggtaagatggctttccttctgcctcctttctctgggcccagcgtcctctgtcctggcagtccaaacacacgtctgatggcgcgagggaggc

SEQ ID NO: 5712 - DNA, 383 bp, Artificial Sequence
  source: /note="Description of Artificial Sequence: Synthetic polynucleotide"
gccttgccagcccgctcagtacgtacgacacacgtcagctggcctctgtctcggacccccattccagacaccagacagagggacaggccccccagaaccagtgttgagggacacccctgtccagggcagccaagtccaagaggcgcgctgagcccagcaagggaaggcccccaaacaaaccaggaggtttctgaagctgtctgtgtcacagtcgggtatagcagcgtacgtacgacacacgtgtcgaccttttgatatctggggccaagggacaatggtcaccgtctcttcaggtaagatggctttccttctgcctcctttctctgggcccagcgtcctctgtcctggtacgtacgacacacgtctgatggcgcgagggaggc

SEQ ID NO: 5713 - DNA, 377 bp, Artificial Sequence
  source: /note="Description of Artificial Sequence: Synthetic polynucleotide"
gccttgccagcccgctcagagtaccgaacacacgtagggttgagggctggggtctcccacgtgttttggggctaacagcggaagggagagcactggcaaaggtgctgggggtcccctgaacccgacccgccctgagaccgcagccacatcagcccccagccccacaggccccctaccagccgcagggtttttggctgagctgagaaccactgtgctaactagtaccgaacacacgtgtcgaccttttgatatctggggccaagggacaatggtcaccgtctcttcaggtaagatggctttccttctgcctcctttctctgggcccagcgtcctctgtcctggagtaccgaacacacgtctgatggcgcgagggaggc

SEQ ID NO: 5714 - DNA, 382 bp, Artificial Sequence
  source: /note="Description of Artificial Sequence: Synthetic polynucleotide"
gccttgccagcccgctcaggacactcttagacggagccccggtctctgtgggtgttccgctaactggggctcccagtgctcaccccacaactaaagcgagccccagcctccagagcccccgaaggagatgccgcccacaagcccagcccccatccaggaggccccagagctcagggcgccggggcagattctgaacagccccgagtcacggtgggtacaactggagacactcttagacggagtcgacagttggacttcccaggccgacagtggtctggcttctgaggggtcaggccagaatgtggggtacgtgggaggccagcagagggttccatgagaagggcagggacactcttagacggactgatggcgcgagggaggc

SEQ ID NO: 5715 - DNA, 382 bp, Artificial Sequence
  source: /note="Description of Artificial Sequence: Synthetic polynucleotide"
gccttgccagcccgctcagttcggaactagacggaggcctcggtctctgtgggtgttccgctagctggggctcacagtgctcaccccacacctaaaacgagccacagcctcagagcccctgaaggagaccccgcccacaagcccagcccccacccaggaggccccagagcacagggcgccccgtcggattctgaacagccccgagtcacagtgggtataactggattcggaactagacggagtcgacagttggacttcccaggccgacagtggtctggcttctgaggggtcaggccagaatgtggggtacgtgggaggccagcagagggttccatgagaagggcaggttcggaactagacggactgatggcgcgagggaggc

SEQ ID NO: 5716 - DNA, 382 bp, Artificial Sequence
  source: /note="Description of Artificial Sequence: Synthetic polynucleotide"
gccttgccagcccgctcagaagtaacgtagacggaggcctcggtctctgtgggtgttccgctagctggggctcacagtgctcaccccacacctaaaatgagccacagcctccggagcccccgcagagaccccgcccacaagcccagcccccacccaggaggccccagagctcagggcgccccgtcggattccgaacagccccgagtcacagcgggtataaccggaaagtaacgtagacggagtcgacagttggacttcccaggccgacagtggtctggcttctgaggggtcaggccagaatgtggggtacgtgggaggccagcagagggttccatgagaagggcaggaagtaacgtagacggactgatggcgcgagggaggc

SEQ ID NO: 5717 - DNA, 382 bp, Artificial Sequence
  source: /note="Description of Artificial Sequence: Synthetic polynucleotide"
gccttgccagcccgctcaggtctcctatagacggagtctctgtgggtgttccgctagctggggcccccagtgctcaccccacacctaaagcgagccccagcctccagagccccctaagcattccccgcccagcagcccagcccctgcccccacccaggaggccccagagctcagggcgcctggtcggattctgaacagccccgagtcacagtgggtataactggagtctcctatagacggagtcgacagttggacttcccaggccgacagtggtctggcttctgaggggtcaggccagaatgtggggtacgtgggaggccagcagagggttccatgagaagggcagggtctcctatagacggactgatggcgcgagggaggc

SEQ ID NO: 5718 - DNA, 385 bp, Artificial Sequence
  source: /note="Description of Artificial Sequence: Synthetic polynucleotide"
gccttgccagcccgctcagagagtgtctagacggaaggcctcaggctctgtgggtgccgctagctggggctgccagtcctcaccccacacctaaggtgagccacagccgccagagcctccacaggagaccccacccagcagcccagcccctacccaggaggccccagagctcagggcgcctgggtggattctgaacagccccgagtcacggtgggtatagtgggagctagagtgtctagacggagtcgacagttggacttcccaggccgacagtggtctggcttctgaggggtcaggccagaatgtggggtacgtgggaggccagcagagggttccatgagaagggcaggagagtgtctagacggactgatggcgcgagggaggc

SEQ ID NO: 5719 - DNA, 396 bp, Artificial Sequence
  source: /note="Description of Artificial Sequence: Synthetic polynucleotide"
gccttgccagcccgctcaggttccgaatagacggaaaaggaggagccccctgtacagcactgggctcagagtcctctcccacacaccctgagtttcagacaaaaaccccctggaaatcatagtatcagcaggagaactagccagagacagcaagaggggactcagtgactcccgcggggacaggaggattttgtgggggctcgtgtcactgtgaggatattgtagtagtaccagctgctgttccgaatagacggagtcgacagttggacttcccaggccgacagtggtctggcttctgaggggtcaggccagaatgtggggtacgtgggaggccagcagagggttccatgagaagggcagggttccgaatagacggactgatggcgcgagggaggc

SEQ ID NO: 5720 - DNA, 396 bp, Artificial Sequence
  source: /note="Description of Artificial Sequence: Synthetic polynucleotide"
gccttgccagcccgctcagcgttactttagacggaaaaggaggagccccttgttcagcactgggctcagagtcctctccaagacacccagagtttcagacaaaaaccccctggaatgcacagtctcagcaggagagccagccagagccagcaagatggggctcagtgacacccgcagggacaggaggattttgtgggggctcgtgtcactgtgaggatattgtactaatggtgtatgctcgttactttagacggagtcgacagttggacttcccaggccgacagtggtctggcttctgaggggtcaggccagaatgtggggtacgtgggaggccagcagagggttccatgagaagggcaggcgttactttagacggactgatggcgcgagggaggc

SEQ ID NO: 5721 - DNA, 396 bp, Artificial Sequence
  source: /note="Description of Artificial Sequence: Synthetic polynucleotide"
gccttgccagcccgctcagtaggagactagacggaaaaggaggagccccctatacagcactgggctcagagtcctctctgagacaccctgagtttcagacaacaacccgctggaatgcacagtctcagcaggagaacagaccaaagccagcaaaagggacctcggtgacaccagtagggacaggaggattttgtgggggctcgtgtcactgtgaggatattgtagtggtggtagctgcttaggagactagacggagtcgacagttggacttcccaggccgacagtggtctggcttctgaggggtcaggccagaatgtggggtacgtgggaggccagcagagggttccatgagaagggcaggtaggagactagacggactgatggcgcgagggaggc

SEQ ID NO: 5722 - DNA, 393 bp, Artificial Sequence
  source: /note="Description of Artificial Sequence: Synthetic polynucleotide"
gccttgccagcccgctcaggtgtctactagacggaagccccctgtacagcactgggctcagagtcctctctgagacaggctcagtttcagacaacaacccgctggaatgcacagtctcagcaggagagccaggccagagccagcaagaggagactcggtgacaccagtctcctgtagggacaggaggattttgtgggggttcgtgtcactgtgagcatattgtggtggtgactgctgtgtctactagacggagtcgacagttggacttcccaggccgacagtggtctggcttctgaggggtcaggccagaatgtggggtacgtgggaggccagcagagggttccatgagaagggcagggtgtctactagacggactgatggcgcgagggaggc

SEQ ID NO: 5723 - DNA, 396 bp, Artificial Sequence
  source: /note="Description of Artificial Sequence: Synthetic polynucleotide"
gccttgccagcccgctcagtgctacactagacggagtgggcacggacactgtccacctaagccaggggcagacccgagtgtccccgcagtagacctgagagcgctgggcccacagcctcccctcggtgccctgctacctcctcaggtcagccctggacatcccgggtttccccaggctggcggtaggtttggggtgaggtctgtgtcactgtggtattacgatttttggagtggttatttgctacactagacggagtcgacagttggacttcccaggccgacagtggtctggcttctgaggggtcaggccagaatgtggggtacgtgggaggccagcagagggttccatgagaagggcaggtgctacactagacggactgatggcgcgagggaggc

SEQ ID NO: 5724 - DNA, 396 bp, Artificial Sequence
  source: /note="Description of Artificial Sequence: Synthetic polynucleotide"
gccttgccagcccgctcagaactgccatagacggatgggcacggacactatccacataagcgagggatagacccgagtgtccccacagcagacctgagagcgctgggcccacagcctcccctcagagccctgctgcctcctccggtcagccctggacatcccaggtttccccaggcctgccggtaggtttagaatgaggtctgtgtcactgtggtattacgatattttgactggttattaactgccatagacggagtcgacagttggacttcccaggccgacagtggtctggcttctgaggggtcaggccagaatgtggggtacgtgggaggccagcagagggttccatgagaagggcaggaactgccatagacggactgatggcgcgagggaggc

SEQ ID NO: 5725 - DNA, 396 bp, Artificial Sequence
  source: /note="Description of Artificial Sequence: Synthetic polynucleotide"
gccttgccagcccgctcagttggactgtagacggacgatattttgactggttattataaccacagtgtcacagagtccatcaaaaacccatgcctggaagcttcccgccacagccctccccatggggccctgctgcctcctcaggtcagccccggacatcccgggtttccccaggctgggcggtaggtttggggtgaggtctgtgtcactgtggtattactatggttcggggagttattttggactgtagacggagtcgacagttggacttcccaggccgacagtggtctggcttctgaggggtcaggccagaatgtggggtacgtgggaggccagcagagggttccatgagaagggcaggttggactgtagacggactgatggcgcgagggaggc

SEQ ID NO: 5726 - DNA, 402 bp, Artificial Sequence
  source: /note="Description of Artificial Sequence: Synthetic polynucleotide"
gccttgccagcccgctcaggtagacactagacggatggacgcggacactatccacataagcgagggacagacccgagtgttcctgcagtagacctgagagcgctgggcccacagcctcccctcggtgccctgctgcctcctcaggtcagccctggacatcccgggtttccccaggccagatggtaggtttgaagtgaggtctgtgtcactgtggtattatgattacgtttgggggagttatcgttgtagacactagacggagtcgacagttggacttcccaggccgacagtggtctggcttctgaggggtcaggccagaatgtggggtacgtgggaggccagcagagggttccatgagaagggcagggtagacactagacggactgatggcgcgagggaggc

SEQ ID NO: 5727 - DNA, 396 bp, Artificial Sequence
  source: /note="Description of Artificial Sequence: Synthetic polynucleotide"
gccttgccagcccgctcagcactgtactagacggatgggcatggacagtgtccacctaagcgagggacagacccgagtgtccctgcagtagacctgagagcgctgggcccacagcctcccctcggggccctgctgcctcctcaggtcagccctggacatcccgggtttccccaggcctggcggtaggtttgaagtgaggtctgtgtcactgtggtattactatgatagtagtggttattcactgtactagacggagtcgacagttggacttcccaggccgacagtggtctggcttctgaggggtcaggccagaatgtggggtacgtgggaggccagcagagggttccatgagaagggcaggcactgtactagacggactgatggcgcgagggaggc

SEQ ID NO: 5728 - DNA, 381 bp, Artificial Sequence
  source: /note="Description of Artificial Sequence: Synthetic polynucleotide"
gccttgccagcccgctcaggatgatcctagacggacaagggtgagtcagaccctcctgccctcgatggcaggcggagaagattcagaaaggtctgagatccccaggacgcagcaccactgtcaatgggggccccagacgcctggaccagggcctgcgtgggaaaggcctctgggcacactcaggggctttttgtgaagggtcctcctactgtgtgactacagtagatgatcctagacggagtcgacagttggacttcccaggccgacagtggtctggcttctgaggggtcaggccagaatgtggggtacgtgggaggccagcagagggttccatgagaagggcagggatgatcctagacggactgatggcgcgagggaggc

SEQ ID NO: 5729 - DNA, 381 bp, Artificial Sequence
  source: /note="Description of Artificial Sequence: Synthetic polynucleotide"
gccttgccagcccgctcagcgccaatatagacggatgcctctctccccagtggacaccctcttccaggacagtcctcagtggcatcacagcggcctgagatccccaggacgcagcaccgctgtcaataggggccccaaatgcctggaccagggcctgcgtgggaaaggtctctggccacactcgggctttttgtgaagggccctcctgctgtgtgactacagtacgccaatatagacggagtcgacagttggacttcccaggccgacagtggtctggcttctgaggggtcaggccagaatgtggggtacgtgggaggccagcagagggttccatgagaagggcaggcgccaatatagacggactgatggcgcgagggaggc

SEQ ID NO: 5730 - DNA, 381 bp, Artificial Sequence
  source: /note="Description of Artificial Sequence: Synthetic polynucleotide"
gccttgccagcccgctcagtcaagccttagacggaggagggtgagtcagacccacctgccctcgatggcaggcggggaagattcagaaaggcctgagatccccaggacgcagcaccactgtcaatgggggccccagacgcctggaccagggcctgcgtgggaaaggccgctgggcacactcaggggctttttgtgaaggcccctcctactgtgtgactacggtgtcaagccttagacggagtcgacagttggacttcccaggccgacagtggtctggcttctgaggggtcaggccagaatgtggggtacgtgggaggccagcagagggttccatgagaagggcaggtcaagccttagacggactgatggcgcgagggaggc

SEQ ID NO: 5731 - DNA, 384 bp, Artificial Sequence
  source: /note="Description of Artificial Sequence: Synthetic polynucleotide"
gccttgccagcccgctcagacgtgtgttagacggaggagggtgagtcagacccacctgccctcaatggcaggcggggaagattcagaaaggcctgagatccccaggacgcagcaccactgtcaatgggggccccagacgcctggaccagggcctgtgtgggaaaggcctctggccacactcaggggctttttgtgaagggccctcctgctgtgtgactacggtggtaacgtgtgttagacggagtcgacagttggacttcccaggccgacagtggtctggcttctgaggggtcaggccagaatgtggggtacgtgggaggccagcagagggttccatgagaagggcaggacgtgtgttagacggactgatggcgcgagggaggc

SEQ ID NO: 5732 - DNA, 385 bp, Artificial Sequence
  source: /note="Description of Artificial Sequence: Synthetic polynucleotide"
gccttgccagcccgctcagtccgtctatagacggaagaggcctctccagggggacactgtgcatgtctggtccctgagcagccccccatgtccccagtcctggggggccccctggcacagctgtctggaccctctctattccctgggaagctcctcctgacagccccgcctccagttccaggtgtggttattgtcagggggtgtcagactgtggtggatacagctatgtccgtctatagacggagtcgacagttggacttcccaggccgacagtggtctggcttctgaggggtcaggccagaatgtggggtacgtgggaggccagcagagggttccatgagaagggcaggtccgtctatagacggactgatggcgcgagggaggc

SEQ ID NO: 5733 - DNA, 388 bp, Artificial Sequence
  source: /note="Description of Artificial Sequence: Synthetic polynucleotide"
gccttgccagcccgctcagaagagctgtagacggagcagaggcctctccagggagacactgtgcatgtctggtacctaagcagccccccacgtccccagtcctgggggcccctggctcagctgtctggaccctccctgttccctgggaagctcctcctgacagccccgcctccagttccaggtgtggttattgtcaggcgatgtcagactgtggtggatatagtggctacgaagagctgtagacggagtcgacagttggacttcccaggccgacagtggtctggcttctgaggggtcaggccagaatgtggggtacgtgggaggccagcagagggttccatgagaagggcaggaagagctgtagacggactgatggcgcgagggaggc

SEQ ID NO: 5734 - DNA, 385 bp, Artificial Sequence
  source: /note="Description of Artificial Sequence: Synthetic polynucleotide"
gccttgccagcccgctcagtatcgctctagacggagcagaggcctctccagggggacactgtgcatgtctggtccctgagcagccccccacgtccccagtcctgggggcccctggcacagctgtctggaccctccctgttccctgggaagctcctcctgacagccccgcctccagttccaggtgtggttattgtcagggggtgtcagactgtggtggatacagctatgtatcgctctagacggagtcgacagttggacttcccaggccgacagtggtctggcttctgaggggtcaggccagaatgtggggtacgtgggaggccagcagagggttccatgagaagggcaggtatcgctctagacggactgatggcgcgagggaggc

SEQ ID NO: 5735 - DNA, 385 bp, Artificial Sequence
  source: /note="Description of Artificial Sequence: Synthetic polynucleotide"
gccttgccagcccgctcagtcagatgctagacggagcagaggcctctccagggggacacagtgcatgtctggtccctgagcagcccccaggctctctagcactgggggcccctggcacagctgtctggaccctccctgttccctgggaagctcctcctgacagccccgcctccagttccaggtgtggttattgtcagggggtgccaggccgtggtagagatggctacatcagatgctagacggagtcgacagttggacttcccaggccgacagtggtctggcttctgaggggtcaggccagaatgtggggtacgtgggaggccagcagagggttccatgagaagggcaggtcagatgctagacggactgatggcgcgagggaggc

SEQ ID NO: 5736 - DNA, 383 bp, Artificial Sequence
  source: /note="Description of Artificial Sequence: Synthetic polynucleotide"
gccttgccagcccgctcaggtgtagcatagacggaaggcagctgactcctgacttggacgcctattccagacaccagacagaggggcaggccccccagaaccagggatgaggacgccccgtcaaggccagaaaagaccaagttgtgctgagcccagcaagggaaggtccccaaacaaaccaggaacgtttctgaaggtgtctgtgtcacagtggagtatagcagctgtgtagcatagacggagtcgacagttggacttcccaggccgacagtggtctggcttctgaggggtcaggccagaatgtggggtacgtgggaggccagcagagggttccatgagaagggcagggtgtagcatagacggactgatggcgcgagggaggc

SEQ ID NO: 5737 - DNA, 386 bp, Artificial Sequence
  source: /note="Description of Artificial Sequence: Synthetic polynucleotide"
gccttgccagcccgctcagtggcagtttagacggaaggcagctgacccctgacttggacccctattccagacaccagacagaggcgcaggccccccagaaccagggttgagggacgccccgtcaaagccagacaaaaccaaggggtgttgagcccagcaagggaaggcccccaaacagaccaggaggtttctgaaggtgtctgtgtcacagtggggtatagcagcagcttggcagtttagacggagtcgacagttggacttcccaggccgacagtggtctggcttctgaggggtcaggccagaatgtggggtacgtgggaggccagcagagggttccatgagaagggcaggtggcagtttagacggactgatggcgcgagggaggc

SEQ ID NO: 5738 - DNA, 386 bp, Artificial Sequence
  source: /note="Description of Artificial Sequence: Synthetic polynucleotide"
gccttgccagcccgctcagcagtccaatagacggatgaggtagctggcctctgtctcggaccccactccagacaccagacagaggggcaggccccccaaaaccagggttgagggatgatccgtcaaggcagacaagaccaaggggcactgaccccagcaagggaaggctcccaaacagacgaggaggtttctgaagctgtctgtatcacagtggggtatagcagtggctcagtccaatagacggagtcgacagttggacttcccaggccgacagtggtctggcttctgaggggtcaggccagaatgtggggtacgtgggaggccagcagagggttccatgagaagggcaggcagtccaatagacggactgatggcgcgagggaggc

SEQ ID NO: 5739 - DNA, 383 bp, Artificial Sequence
  source: /note="Description of Artificial Sequence: Synthetic polynucleotide"
gccttgccagcccgctcagtacgtacgtagacggacagctggcctctgtctcggacccccattccagacaccagacagagggacaggccccccagaaccagtgttgagggacacccctgtccagggcagccaagtccaagaggcgcgctgagcccagcaagggaaggcccccaaacaaaccaggaggtttctgaagctgtctgtgtcacagtcgggtatagcagcgtacgtacgtagacggagtcgacagttggacttcccaggccgacagtggtctggcttctgaggggtcaggccagaatgtggggtacgtgggaggccagcagagggttccatgagaagggcaggtacgtacgtagacggactgatggcgcgagggaggc

SEQ ID NO: 5740 - DNA, 377 bp, Artificial Sequence
  source: /note="Description of Artificial Sequence: Synthetic polynucleotide"
gccttgccagcccgctcagagtaccgatagacggaagggttgagggctggggtctcccacgtgttttggggctaacagcggaagggagagcactggcaaaggtgctgggggtcccctgaacccgacccgccctgagaccgcagccacatcagcccccagccccacaggccccctaccagccgcagggtttttggctgagctgagaaccactgtgctaactagtaccgatagacggagtcgacagttggacttcccaggccgacagtggtctggcttctgaggggtcaggccagaatgtggggtacgtgggaggccagcagagggttccatgagaagggcaggagtaccgatagacggactgatggcgcgagggaggc

SEQ ID NO: 5741 - DNA, 382 bp, Artificial Sequence
  source: /note="Description of Artificial Sequence: Synthetic polynucleotide"
gccttgccagcccgctcaggacactctcagctcttgccccggtctctgtgggtgttccgctaactggggctcccagtgctcaccccacaactaaagcgagccccagcctccagagcccccgaaggagatgccgcccacaagcccagcccccatccaggaggccccagagctcagggcgccggggcagattctgaacagccccgagtcacggtgggtacaactggagacactctcagctcttgtcgactttgactactggggccagggaaccctggtcaccgtctcctcaggtgagtcctcacaacctctctcctgctttaactctgaagggttttgctgcatttctggacactctcagctcttctgatggcgcgagggaggc

SEQ ID NO: 5742 - DNA, 382 bp, Artificial Sequence
  source: /note="Description of Artificial Sequence: Synthetic polynucleotide"
gccttgccagcccgctcagttcggaaccagctcttggcctcggtctctgtgggtgttccgctagctggggctcacagtgctcaccccacacctaaaacgagccacagcctcagagcccctgaaggagaccccgcccacaagcccagcccccacccaggaggccccagagcacagggcgccccgtcggattctgaacagccccgagtcacagtgggtataactggattcggaaccagctcttgtcgactttgactactggggccagggaaccctggtcaccgtctcctcaggtgagtcctcacaacctctctcctgctttaactctgaagggttttgctgcatttctgttcggaaccagctcttctgatggcgcgagggaggc

SEQ ID NO: 5743 - DNA, 382 bp, Artificial Sequence
  source: /note="Description of Artificial Sequence: Synthetic polynucleotide"
gccttgccagcccgctcagaagtaacgcagctcttggcctcggtctctgtgggtgttccgctagctggggctcacagtgctcaccccacacctaaaatgagccacagcctccggagcccccgcagagaccccgcccacaagcccagcccccacccaggaggccccagagctcagggcgccccgtcggattccgaacagccccgagtcacagcgggtataaccggaaagtaacgcagctcttgtcgactttgactactggggccagggaaccctggtcaccgtctcctcaggtgagtcctcacaacctctctcctgctttaactctgaagggttttgctgcatttctgaagtaacgcagctcttctgatggcgcgagggaggc

SEQ ID NO: 5744 - DNA, 382 bp, Artificial Sequence
  source: /note="Description of Artificial Sequence: Synthetic polynucleotide"
gccttgccagcccgctcaggtctcctacagctcttgtctctgtgggtgttccgctagctggggcccccagtgctcaccccacacctaaagcgagccccagcctccagagccccctaagcattccccgcccagcagcccagcccctgcccccacccaggaggccccagagctcagggcgcctggtcggattctgaacagccccgagtcacagtgggtataactggagtctcctacagctcttgtcgactttgactactggggccagggaaccctggtcaccgtctcctcaggtgagtcctcacaacctctctcctgctttaactctgaagggttttgctgcatttctggtctcctacagctcttctgatggcgcgagggaggc

SEQ ID NO: 5745 - DNA, 385 bp, Artificial Sequence
  source: /note="Description of Artificial Sequence: Synthetic polynucleotide"
gccttgccagcccgctcagagagtgtccagctcttaggcctcaggctctgtgggtgccgctagctggggctgccagtcctcaccccacacctaaggtgagccacagccgccagagcctccacaggagaccccacccagcagcccagcccctacccaggaggccccagagctcagggcgcctgggtggattctgaacagccccgagtcacggtgggtatagtgggagctagagtgtccagctcttgtcgactttgactactggggccagggaaccctggtcaccgtctcctcaggtgagtcctcacaacctctctcctgctttaactctgaagggttttgctgcatttctgagagtgtccagctcttctgatggcgcgagggaggc

SEQ ID NO: 5746 - DNA, 396 bp, Artificial Sequence
  source: /note="Description of Artificial Sequence: Synthetic polynucleotide"
gccttgccagcccgctcaggttccgaacagctcttaaaggaggagccccctgtacagcactgggctcagagtcctctcccacacaccctgagtttcagacaaaaaccccctggaaatcatagtatcagcaggagaactagccagagacagcaagaggggactcagtgactcccgcggggacaggaggattttgtgggggctcgtgtcactgtgaggatattgtagtagtaccagctgctgttccgaacagctcttgtcgactttgactactggggccagggaaccctggtcaccgtctcctcaggtgagtcctcacaacctctctcctgctttaactctgaagggttttgctgcatttctggttccgaacagctcttctgatggcgcgagggaggc

SEQ ID NO: 5747 - DNA, 396 bp, Artificial Sequence
  source: /note="Description of Artificial Sequence: Synthetic polynucleotide"
gccttgccagcccgctcagcgttacttcagctcttaaaggaggagccccttgttcagcactgggctcagagtcctctccaagacacccagagtttcagacaaaaaccccctggaatgcacagtctcagcaggagagccagccagagccagcaagatggggctcagtgacacccgcagggacaggaggattttgtgggggctcgtgtcactgtgaggatattgtactaatggtgtatgctcgttacttcagctcttgtcgactttgactactggggccagggaaccctggtcaccgtctcctcaggtgagtcctcacaacctctctcctgctttaactctgaagggttttgctgcatttctgcgttacttcagctcttctgatggcgcgagggaggc

SEQ ID NO: 5748 - DNA, 396 bp, Artificial Sequence
  source: /note="Description of Artificial Sequence: Synthetic polynucleotide"
gccttgccagcccgctcagtaggagaccagctcttaaaggaggagccccctatacagcactgggctcagagtcctctctgagacaccctgagtttcagacaacaacccgctggaatgcacagtctcagcaggagaacagaccaaagccagcaaaagggacctcggtgacaccagtagggacaggaggattttgtgggggctcgtgtcactgtgaggatattgtagtggtggtagctgcttaggagaccagctcttgtcgactttgactactggggccagggaaccctggtcaccgtctcctcaggtgagtcctcacaacctctctcctgctttaactctgaagggttttgctgcatttctgtaggagaccagctcttctgatggcgcgagggaggc

SEQ ID NO: 5749 - DNA, 393 bp, Artificial Sequence
  source: /note="Description of Artificial Sequence: Synthetic polynucleotide"
gccttgccagcccgctcaggtgtctaccagctcttagccccctgtacagcactgggctcagagtcctctctgagacaggctcagtttcagacaacaacccgctggaatgcacagtctcagcaggagagccaggccagagccagcaagaggagactcggtgacaccagtctcctgtagggacaggaggattttgtgggggttcgtgtcactgtgagcatattgtggtggtgactgctgtgtctaccagctcttgtcgactttgactactggggccagggaaccctggtcaccgtctcctcaggtgagtcctcacaacctctctcctgctttaactctgaagggttttgctgcatttctggtgtctaccagctcttctgatggcgcgagggaggc

SEQ ID NO: 5750 - DNA, 396 bp, Artificial Sequence
  source: /note="Description of Artificial Sequence: Synthetic polynucleotide"
gccttgccagcccgctcagtgctacaccagctcttgtgggcacggacactgtccacctaagccaggggcagacccgagtgtccccgcagtagacctgagagcgctgggcccacagcctcccctcggtgccctgctacctcctcaggtcagccctggacatcccgggtttccccaggctggcggtaggtttggggtgaggtctgtgtcactgtggtattacgatttttggagtggttatttgctacaccagctcttgtcgactttgactactggggccagggaaccctggtcaccgtctcctcaggtgagtcctcacaacctctctcctgctttaactctgaagggttttgctgcatttctgtgctacaccagctcttctgatggcgcgagggaggc

SEQ ID NO: 5751 - DNA, 396 bp, Artificial Sequence
  source: /note="Description of Artificial Sequence: Synthetic polynucleotide"
gccttgccagcccgctcagaactgccacagctctttgggcacggacactatccacataagcgagggatagacccgagtgtccccacagcagacctgagagcgctgggcccacagcctcccctcagagccctgctgcctcctccggtcagccctggacatcccaggtttccccaggcctgccggtaggtttagaatgaggtctgtgtcactgtggtattacgatattttgactggttattaactgccacagctcttgtcgactttgactactggggccagggaaccctggtcaccgtctcctcaggtgagtcctcacaacctctctcctgctttaactctgaagggttttgctgcatttctgaactgccacagctcttctgatggcgcgagggaggc

SEQ ID NO: 5752 - DNA, 396 bp, Artificial Sequence
  source: /note="Description of Artificial Sequence: Synthetic polynucleotide"
gccttgccagcccgctcagttggactgcagctcttcgatattttgactggttattataaccacagtgtcacagagtccatcaaaaacccatgcctggaagcttcccgccacagccctccccatggggccctgctgcctcctcaggtcagccccggacatcccgggtttccccaggctgggcggtaggtttggggtgaggtctgtgtcactgtggtattactatggttcggggagttattttggactgcagctcttgtcgactttgactactggggccagggaaccctggtcaccgtctcctcaggtgagtcctcacaacctctctcctgctttaactctgaagggttttgctgcatttctgttggactgcagctcttctgatggcgcgagggaggc

SEQ ID NO: 5753 - DNA, 402 bp, Artificial Sequence
  source: /note="Description of Artificial Sequence: Synthetic polynucleotide"
gccttgccagcccgctcaggtagacaccagctctttggacgcggacactatccacataagcgagggacagacccgagtgttcctgcagtagacctgagagcgctgggcccacagcctcccctcggtgccctgctgcctcctcaggtcagccctggacatcccgggtttccccaggccagatggtaggtttgaagtgaggtctgtgtcactgtggtattatgattacgtttgggggagttatcgttgtagacaccagctcttgtcgactttgactactggggccagggaaccctggtcaccgtctcctcaggtgagtcctcacaacctctctcctgctttaactctgaagggttttgctgcatttctggtagacaccagctcttctgatggcgcgagggaggc

SEQ ID NO: 5754 - DNA, 396 bp, Artificial Sequence
  source: /note="Description of Artificial Sequence: Synthetic polynucleotide"
gccttgccagcccgctcagcactgtaccagctctttgggcatggacagtgtccacctaagcgagggacagacccgagtgtccctgcagtagacctgagagcgctgggcccacagcctcccctcggggccctgctgcctcctcaggtcagccctggacatcccgggtttccccaggcctggcggtaggtttgaagtgaggtctgtgtcactgtggtattactatgatagtagtggttattcactgtaccagctcttgtcgactttgactactggggccagggaaccctggtcaccgtctcctcaggtgagtcctcacaacctctctcctgctttaactctgaagggttttgctgcatttctgcactgtaccagctcttctgatggcgcgagggaggc

SEQ ID NO: 5755 - DNA, 381 bp, Artificial Sequence
  source: /note="Description of Artificial Sequence: Synthetic polynucleotide"
gccttgccagcccgctcaggatgatcccagctcttcaagggtgagtcagaccctcctgccctcgatggcaggcggagaagattcagaaaggtctgagatccccaggacgcagcaccactgtcaatgggggccccagacgcctggaccagggcctgcgtgggaaaggcctctgggcacactcaggggctttttgtgaagggtcctcctactgtgtgactacagtagatgatcccagctcttgtcgactttgactactggggccagggaaccctggtcaccgtctcctcaggtgagtcctcacaacctctctcctgctttaactctgaagggttttgctgcatttctggatgatcccagctcttctgatggcgcgagggaggc

SEQ ID NO: 5756 - DNA, 381 bp, Artificial Sequence
  source: /note="Description of Artificial Sequence: Synthetic polynucleotide"
gccttgccagcccgctcagcgccaatacagctctttgcctctctccccagtggacaccctcttccaggacagtcctcagtggcatcacagcggcctgagatccccaggacgcagcaccgctgtcaataggggccccaaatgcctggaccagggcctgcgtgggaaaggtctctggccacactcgggctttttgtgaagggccctcctgctgtgtgactacagtacgccaatacagctcttgtcgactttgactactggggccagggaaccctggtcaccgtctcctcaggtgagtcctcacaacctctctcctgctttaactctgaagggttttgctgcatttctgcgccaatacagctcttctgatggcgcgagggaggc

SEQ ID NO: 5757 - DNA, 381 bp, Artificial Sequence
  source: /note="Description of Artificial Sequence: Synthetic polynucleotide"
gccttgccagcccgctcagtcaagcctcagctcttggagggtgagtcagacccacctgccctcgatggcaggcggggaagattcagaaaggcctgagatccccaggacgcagcaccactgtcaatgggggccccagacgcctggaccagggcctgcgtgggaaaggccgctgggcacactcaggggctttttgtgaaggcccctcctactgtgtgactacggtgtcaagcctcagctcttgtcgactttgactactggggccagggaaccctggtcaccgtctcctcaggtgagtcctcacaacctctctcctgctttaactctgaagggttttgctgcatttctgtcaagcctcagctcttctgatggcgcgagggaggc

SEQ ID NO: 5758 - DNA, 384 bp, Artificial Sequence
  source: /note="Description of Artificial Sequence: Synthetic polynucleotide"
gccttgccagcccgctcagacgtgtgtcagctcttggagggtgagtcagacccacctgccctcaatggcaggcggggaagattcagaaaggcctgagatccccaggacgcagcaccactgtcaatgggggccccagacgcctggaccagggcctgtgtgggaaaggcctctggccacactcaggggctttttgtgaagggccctcctgctgtgtgactacggtggtaacgtgtgtcagctcttgtcgactttgactactggggccagggaaccctggtcaccgtctcctcaggtgagtcctcacaacctctctcctgctttaactctgaagggttttgctgcatttctgacgtgtgtcagctcttctgatggcgcgagggaggc

SEQ ID NO: 5759 - DNA, 385 bp, Artificial Sequence
  source: /note="Description of Artificial Sequence: Synthetic polynucleotide"
gccttgccagcccgctcagtccgtctacagctcttagaggcctctccagggggacactgtgcatgtctggtccctgagcagccccccatgtccccagtcctggggggccccctggcacagctgtctggaccctctctattccctgggaagctcctcctgacagccccgcctccagttccaggtgtggttattgtcagggggtgtcagactgtggtggatacagctatgtccgtctacagctcttgtcgactttgactactggggccagggaaccctggtcaccgtctcctcaggtgagtcctcacaacctctctcctgctttaactctgaagggttttgctgcatttctgtccgtctacagctcttctgatggcgcgagggaggc

SEQ ID NO: 5760 - DNA, 388 bp, Artificial Sequence
  source: /note="Description of Artificial Sequence: Synthetic polynucleotide"
gccttgccagcccgctcagaagagctgcagctcttgcagaggcctctccagggagacactgtgcatgtctggtacctaagcagccccccacgtccccagtcctgggggcccctggctcagctgtctggaccctccctgttccctgggaagctcctcctgacagccccgcctccagttccaggtgtggttattgtcaggcgatgtcagactgtggtggatatagtggctacgaagagctgcagctcttgtcgactttgactactggggccagggaaccctggtcaccgtctcctcaggtgagtcctcacaacctctctcctgctttaactctgaagggttttgctgcatttctgaagagctgcagctcttctgatggcgcgagggaggc

SEQ ID NO: 5761 - DNA, 385 bp, Artificial Sequence
  source: /note="Description of Artificial Sequence: Synthetic polynucleotide"
gccttgccagcccgctcagtatcgctccagctcttgcagaggcctctccagggggacactgtgcatgtctggtccctgagcagccccccacgtccccagtcctgggggcccctggcacagctgtctggaccctccctgttccctgggaagctcctcctgacagccccgcctccagttccaggtgtggttattgtcagggggtgtcagactgtggtggatacagctatgtatcgctccagctcttgtcgactttgactactggggccagggaaccctggtcaccgtctcctcaggtgagtcctcacaacctctctcctgctttaactctgaagggttttgctgcatttctgtatcgctccagctcttctgatggcgcgagggaggc

SEQ ID NO: 5762 - DNA, 385 bp, Artificial Sequence
  source: /note="Description of Artificial Sequence: Synthetic polynucleotide"
gccttgccagcccgctcagtcagatgccagctcttgcagaggcctctccagggggacacagtgcatgtctggtccctgagcagcccccaggctctctagcactgggggcccctggcacagctgtctggaccctccctgttccctgggaagctcctcctgacagccccgcctccagttccaggtgtggttattgtcagggggtgccaggccgtggtagagatggctacatcagatgccagctcttgtcgactttgactactggggccagggaaccctggtcaccgtctcctcaggtgagtcctcacaacctctctcctgctttaactctgaagggttttgctgcatttctgtcagatgccagctcttctgatggcgcgagggaggc

SEQ ID NO: 5763 - DNA, 383 bp, Artificial Sequence
  source: /note="Description of Artificial Sequence: Synthetic polynucleotide"
gccttgccagcccgctcaggtgtagcacagctcttaggcagctgactcctgacttggacgcctattccagacaccagacagaggggcaggccccccagaaccagggatgaggacgccccgtcaaggccagaaaagaccaagttgtgctgagcccagcaagggaaggtccccaaacaaaccaggaacgtttctgaaggtgtctgtgtcacagtggagtatagcagctgtgtagcacagctcttgtcgactttgactactggggccagggaaccctggtcaccgtctcctcaggtgagtcctcacaacctctctcctgctttaactctgaagggttttgctgcatttctggtgtagcacagctcttctgatggcgcgagggaggc

SEQ ID NO: 5764 - DNA, 386 bp, Artificial Sequence
  source: /note="Description of Artificial Sequence: Synthetic polynucleotide"
gccttgccagcccgctcagtggcagttcagctcttaggcagctgacccctgacttggacccctattccagacaccagacagaggcgcaggccccccagaaccagggttgagggacgccccgtcaaagccagacaaaaccaaggggtgttgagcccagcaagggaaggcccccaaacagaccaggaggtttctgaaggtgtctgtgtcacagtggggtatagcagcagcttggcagttcagctcttgtcgactttgactactggggccagggaaccctggtcaccgtctcctcaggtgagtcctcacaacctctctcctgctttaactctgaagggttttgctgcatttctgtggcagttcagctcttctgatggcgcgagggaggc

SEQ ID NO: 5765 - DNA, 386 bp, Artificial Sequence
  source: /note="Description of Artificial Sequence: Synthetic polynucleotide"
gccttgccagcccgctcagcagtccaacagctctttgaggtagctggcctctgtctcggaccccactccagacaccagacagaggggcaggccccccaaaaccagggttgagggatgatccgtcaaggcagacaagaccaaggggcactgaccccagcaagggaaggctcccaaacagacgaggaggtttctgaagctgtctgtatcacagtggggtatagcagtggctcagtccaacagctcttgtcgactttgactactggggccagggaaccctggtcaccgtctcctcaggtgagtcctcacaacctctctcctgctttaactctgaagggttttgctgcatttctgcagtccaacagctcttctgatggcgcgagggaggc

SEQ ID NO: 5766 - DNA, 383 bp, Artificial Sequence
  source: /note="Description of Artificial Sequence: Synthetic polynucleotide"
gccttgccagcccgctcagtacgtacgcagctcttcagctggcctctgtctcggacccccattccagacaccagacagagggacaggccccccagaaccagtgttgagggacacccctgtccagggcagccaagtccaagaggcgcgctgagcccagcaagggaaggcccccaaacaaaccaggaggtttctgaagctgtctgtgtcacagtcgggtatagcagcgtacgtacgcagctcttgtcgactttgactactggggccagggaaccctggtcaccgtctcctcaggtgagtcctcacaacctctctcctgctttaactctgaagggttttgctgcatttctgtacgtacgcagctcttctgatggcgcgagggaggc

SEQ ID NO: 5767 - DNA, 377 bp, Artificial Sequence
  source: /note="Description of Artificial Sequence: Synthetic polynucleotide"
gccttgccagcccgctcagagtaccgacagctcttagggttgagggctggggtctcccacgtgttttggggctaacagcggaagggagagcactggcaaaggtgctgggggtcccctgaacccgacccgccctgagaccgcagccacatcagcccccagccccacaggccccctaccagccgcagggtttttggctgagctgagaaccactgtgctaactagtaccgacagctcttgtcgactttgactactggggccagggaaccctggtcaccgtctcctcaggtgagtcctcacaacctctctcctgctttaactctgaagggttttgctgcatttctgagtaccgacagctcttctgatggcgcgagggaggc

SEQ ID NO: 5768 - DNA, 382 bp, Artificial Sequence
  source: /note="Description of Artificial Sequence: Synthetic polynucleotide"
gccttgccagcccgctcaggacactctgagcgatagccccggtctctgtgggtgttccgctaactggggctcccagtgctcaccccacaactaaagcgagccccagcctccagagcccccgaaggagatgccgcccacaagcccagcccccatccaggaggccccagagctcagggcgccggggcagattctgaacagccccgagtcacggtgggtacaactggagacactctgagcgatagtcgactggttcgacccctggggccagggaaccctggtcaccgtctcctcaggtgagtcctcaccaccccctctctgagtccacttagggagactcagcttgccaggacactctgagcgatactgatggcgcgagggaggc

SEQ ID NO: 5769 - DNA, 382 bp, Artificial Sequence
  source: /note="Description of Artificial Sequence: Synthetic polynucleotide"
gccttgccagcccgctcagttcggaacgagcgataggcctcggtctctgtgggtgttccgctagctggggctcacagtgctcaccccacacctaaaacgagccacagcctcagagcccctgaaggagaccccgcccacaagcccagcccccacccaggaggccccagagcacagggcgccccgtcggattctgaacagccccgagtcacagtgggtataactggattcggaacgagcgatagtcgactggttcgacccctggggccagggaaccctggtcaccgtctcctcaggtgagtcctcaccaccccctctctgagtccacttagggagactcagcttgccagttcggaacgagcgatactgatggcgcgagggaggc

SEQ ID NO: 5770 - DNA, 382 bp, Artificial Sequence
  source: /note="Description of Artificial Sequence: Synthetic polynucleotide"
gccttgccagcccgctcagaagtaacggagcgataggcctcggtctctgtgggtgttccgctagctggggctcacagtgctcaccccacacctaaaatgagccacagcctccggagcccccgcagagaccccgcccacaagcccagcccccacccaggaggccccagagctcagggcgccccgtcggattccgaacagccccgagtcacagcgggtataaccggaaagtaacggagcgatagtcgactggttcgacccctggggccagggaaccctggtcaccgtctcctcaggtgagtcctcaccaccccctctctgagtccacttagggagactcagcttgccagaagtaacggagcgatactgatggcgcgagggaggc

SEQ ID NO: 5771 - DNA, 382 bp, Artificial Sequence
  source: /note="Description of Artificial Sequence: Synthetic polynucleotide"
gccttgccagcccgctcaggtctcctagagcgatagtctctgtgggtgttccgctagctggggcccccagtgctcaccccacacctaaagcgagccccagcctccagagccccctaagcattccccgcccagcagcccagcccctgcccccacccaggaggccccagagctcagggcgcctggtcggattctgaacagccccgagtcacagtgggtataactggagtctcctagagcgatagtcgactggttcgacccctggggccagggaaccctggtcaccgtctcctcaggtgagtcctcaccaccccctctctgagtccacttagggagactcagcttgccaggtctcctagagcgatactgatggcgcgagggaggc

SEQ ID NO: 5772 - DNA, 385 bp, Artificial Sequence
  source: /note="Description of Artificial Sequence: Synthetic polynucleotide"
gccttgccagcccgctcagagagtgtcgagcgataaggcctcaggctctgtgggtgccgctagctggggctgccagtcctcaccccacacctaaggtgagccacagccgccagagcctccacaggagaccccacccagcagcccagcccctacccaggaggccccagagctcagggcgcctgggtggattctgaacagccccgagtcacggtgggtatagtgggagctagagtgtcgagcgatagtcgactggttcgacccctggggccagggaaccctggtcaccgtctcctcaggtgagtcctcaccaccccctctctgagtccacttagggagactcagcttgccagagagtgtcgagcgatactgatggcgcgagggaggc

SEQ ID NO: 5773 - DNA, 396 bp, Artificial Sequence
  source: /note="Description of Artificial Sequence: Synthetic polynucleotide"
gccttgccagcccgctcaggttccgaagagcgataaaaggaggagccccctgtacagcactgggctcagagtcctctcccacacaccctgagtttcagacaaaaaccccctggaaatcatagtatcagcaggagaactagccagagacagcaagaggggactcagtgactcccgcggggacaggaggattttgtgggggctcgtgtcactgtgaggatattgtagtagtaccagctgctgttccgaagagcgatagtcgactggttcgacccctggggccagggaaccctggtcaccgtctcctcaggtgagtcctcaccaccccctctctgagtccacttagggagactcagcttgccaggttccgaagagcgatactgatggcgcgagggaggc

SEQ ID NO: 5774 - DNA, 396 bp, Artificial Sequence
  source: /note="Description of Artificial Sequence: Synthetic polynucleotide"
gccttgccagcccgctcagcgttacttgagcgataaaaggaggagccccttgttcagcactgggctcagagtcctctccaagacacccagagtttcagacaaaaaccccctggaatgcacagtctcagcaggagagccagccagagccagcaagatggggctcagtgacacccgcagggacaggaggattttgtgggggctcgtgtcactgtgaggatattgtactaatggtgtatgctcgttacttgagcgatagtcgactggttcgacccctggggccagggaaccctggtcaccgtctcctcaggtgagtcctcaccaccccctctctgagtccacttagggagactcagcttgccagcgttacttgagcgatactgatggcgcgagggaggc

SEQ ID NO: 5775 - DNA, 396 bp, Artificial Sequence
  source: /note="Description of Artificial Sequence: Synthetic polynucleotide"
gccttgccagcccgctcagtaggagacgagcgataaaaggaggagccccctatacagcactgggctcagagtcctctctgagacaccctgagtttcagacaacaacccgctggaatgcacagtctcagcaggagaacagaccaaagccagcaaaagggacctcggtgacaccagtagggacaggaggattttgtgggggctcgtgtcactgtgaggatattgtagtggtggtagctgcttaggagacgagcgatagtcgactggttcgacccctggggccagggaaccctggtcaccgtctcctcaggtgagtcctcaccaccccctctctgagtccacttagggagactcagcttgccagtaggagacgagcgatactgatggcgcgagggaggc

SEQ ID NO: 5776 - DNA, 393 bp, Artificial Sequence
  source: /note="Description of Artificial Sequence: Synthetic polynucleotide"
gccttgccagcccgctcaggtgtctacgagcgataagccccctgtacagcactgggctcagagtcctctctgagacaggctcagtttcagacaacaacccgctggaatgcacagtctcagcaggagagccaggccagagccagcaagaggagactcggtgacaccagtctcctgtagggacaggaggattttgtgggggttcgtgtcactgtgagcatattgtggtggtgactgctgtgtctacgagcgatagtcgactggttcgacccctggggccagggaaccctggtcaccgtctcctcaggtgagtcctcaccaccccctctctgagtccacttagggagactcagcttgccaggtgtctacgagcgatactgatggcgcgagggaggc

SEQ ID NO: 5777 - DNA, 396 bp, Artificial Sequence
  source: /note="Description of Artificial Sequence: Synthetic polynucleotide"
gccttgccagcccgctcagtgctacacgagcgatagtgggcacggacactgtccacctaagccaggggcagacccgagtgtccccgcagtagacctgagagcgctgggcccacagcctcccctcggtgccctgctacctcctcaggtcagccctggacatcccgggtttccccaggctggcggtaggtttggggtgaggtctgtgtcactgtggtattacgatttttggagtggttatttgctacacgagcgatagtcgactggttcgacccctggggccagggaaccctggtcaccgtctcctcaggtgagtcctcaccaccccctctctgagtccacttagggagactcagcttgccagtgctacacgagcgatactgatggcgcgagggaggc

SEQ ID NO: 5778 - DNA, 396 bp, Artificial Sequence
  source: /note="Description of Artificial Sequence: Synthetic polynucleotide"
gccttgccagcccgctcagaactgccagagcgatatgggcacggacactatccacataagcgagggatagacccgagtgtccccacagcagacctgagagcgctgggcccacagcctcccctcagagccctgctgcctcctccggtcagccctggacatcccaggtttccccaggcctgccggtaggtttagaatgaggtctgtgtcactgtggtattacgatattttgactggttattaactgccagagcgatagtcgactggttcgacccctggggccagggaaccctggtcaccgtctcctcaggtgagtcctcaccaccccctctctgagtccacttagggagactcagcttgccagaactgccagagcgatactgatggcgcgagggaggc

SEQ ID NO: 5779 - DNA, 396 bp, Artificial Sequence
  source: /note="Description of Artificial Sequence: Synthetic polynucleotide"
gccttgccagcccgctcagttggactggagcgatacgatattttgactggttattataaccacagtgtcacagagtccatcaaaaacccatgcctggaagcttcccgccacagccctccccatggggccctgctgcctcctcaggtcagccccggacatcccgggtttccccaggctgggcggtaggtttggggtgaggtctgtgtcactgtggtattactatggttcggggagttattttggactggagcgatagtcgactggttcgacccctggggccagggaaccctggtcaccgtctcctcaggtgagtcctcaccaccccctctctgagtccacttagggagactcagcttgccagttggactggagcgatactgatggcgcgagggaggc

SEQ ID NO: 5780 - DNA, 402 bp, Artificial Sequence
  source: /note="Description of Artificial Sequence: Synthetic polynucleotide"
gccttgccagcccgctcaggtagacacgagcgatatggacgcggacactatccacataagcgagggacagacccgagtgttcctgcagtagacctgagagcgctgggcccacagcctcccctcggtgccctgctgcctcctcaggtcagccctggacatcccgggtttccccaggccagatggtaggtttgaagtgaggtctgtgtcactgtggtattatgattacgtttgggggagttatcgttgtagacacgagcgatagtcgactggttcgacccctggggccagggaaccctggtcaccgtctcctcaggtgagtcctcaccaccccctctctgagtccacttagggagactcagcttgccaggtagacacgagcgatactgatggcgcgagggaggc

SEQ ID NO: 5781 - DNA, 396 bp, Artificial Sequence
  source: /note="Description of Artificial Sequence: Synthetic polynucleotide"
gccttgccagcccgctcagcactgtacgagcgatatgggcatggacagtgtccacctaagcgagggacagacccgagtgtccctgcagtagacctgagagcgctgggcccacagcctcccctcggggccctgctgcctcctcaggtcagccctggacatcccgggtttccccaggcctggcggtaggtttgaagtgaggtctgtgtcactgtggtattactatgatagtagtggttattcactgtacgagcgatagtcgactggttcgacccctggggccagggaaccctggtcaccgtctcctcaggtgagtcctcaccaccccctctctgagtccacttagggagactcagcttgccagcactgtacgagcgatactgatggcgcgagggaggc

SEQ ID NO: 5782 - DNA, 381 bp, Artificial Sequence
  source: /note="Description of Artificial Sequence: Synthetic polynucleotide"
gccttgccagcccgctcaggatgatccgagcgatacaagggtgagtcagaccctcctgccctcgatggcaggcggagaagattcagaaaggtctgagatccccaggacgcagcaccactgtcaatgggggccccagacgcctggaccagggcctgcgtgggaaaggcctctgggcacactcaggggctttttgtgaagggtcctcctactgtgtgactacagtagatgatccgagcgatagtcgactggttcgacccctggggccagggaaccctggtcaccgtctcctcaggtgagtcctcaccaccccctctctgagtccacttagggagactcagcttgccaggatgatccgagcgatactgatggcgcgagggaggc

SEQ ID NO: 5783 - DNA, 381 bp, Artificial Sequence
  source: /note="Description of Artificial Sequence: Synthetic polynucleotide"
gccttgccagcccgctcagcgccaatagagcgatatgcctctctccccagtggacaccctcttccaggacagtcctcagtggcatcacagcggcctgagatccccaggacgcagcaccgctgtcaataggggccccaaatgcctggaccagggcctgcgtgggaaaggtctctggccacactcgggctttttgtgaagggccctcctgctgtgtgactacagtacgccaatagagcgatagtcgactggttcgacccctggggccagggaaccctggtcaccgtctcctcaggtgagtcctcaccaccccctctctgagtccacttagggagactcagcttgccagcgccaatagagcgatactgatggcgcgagggaggc

SEQ ID NO: 5784 - DNA, 381 bp, Artificial Sequence
  source: /note="Description of Artificial Sequence: Synthetic polynucleotide"
gccttgccagcccgctcagtcaagcctgagcgataggagggtgagtcagacccacctgccctcgatggcaggcggggaagattcagaaaggcctgagatccccaggacgcagcaccactgtcaatgggggccccagacgcctggaccagggcctgcgtgggaaaggccgctgggcacactcaggggctttttgtgaaggcccctcctactgtgtgactacggtgtcaagcctgagcgatagtcgactggttcgacccctggggccagggaaccctggtcaccgtctcctcaggtgagtcctcaccaccccctctctgagtccacttagggagactcagcttgccagtcaagcctgagcgatactgatggcgcgagggaggc

SEQ ID NO: 5785 - DNA, 384 bp, Artificial Sequence
  source: /note="Description of Artificial Sequence: Synthetic polynucleotide"
gccttgccagcccgctcagacgtgtgtgagcgataggagggtgagtcagacccacctgccctcaatggcaggcggggaagattcagaaaggcctgagatccccaggacgcagcaccactgtcaatgggggccccagacgcctggaccagggcctgtgtgggaaaggcctctggccacactcaggggctttttgtgaagggccctcctgctgtgtgactacggtggtaacgtgtgtgagcgatagtcgactggttcgacccctggggccagggaaccctggtcaccgtctcctcaggtgagtcctcaccaccccctctctgagtccacttagggagactcagcttgccagacgtgtgtgagcgatactgatggcgcgagggaggc

SEQ ID NO: 5786 - DNA, 385 bp, Artificial Sequence
  source: /note="Description of Artificial Sequence: Synthetic polynucleotide"
gccttgccagcccgctcagtccgtctagagcgataagaggcctctccagggggacactgtgcatgtctggtccctgagcagccccccatgtccccagtcctggggggccccctggcacagctgtctggaccctctctattccctgggaagctcctcctgacagccccgcctccagttccaggtgtggttattgtcagggggtgtcagactgtggtggatacagctatgtccgtctagagcgatagtcgactggttcgacccctggggccagggaaccctggtcaccgtctcctcaggtgagtcctcaccaccccctctctgagtccacttagggagactcagcttgccagtccgtctagagcgatactgatggcgcgagggaggc

SEQ ID NO: 5787 - DNA, 388 bp, Artificial Sequence
  source: /note="Description of Artificial Sequence: Synthetic polynucleotide"
gccttgccagcccgctcagaagagctggagcgatagcagaggcctctccagggagacactgtgcatgtctggtacctaagcagccccccacgtccccagtcctgggggcccctggctcagctgtctggaccctccctgttccctgggaagctcctcctgacagccccgcctccagttccaggtgtggttattgtcaggcgatgtcagactgtggtggatatagtggctacgaagagctggagcgatagtcgactggttcgacccctggggccagggaaccctggtcaccgtctcctcaggtgagtcctcaccaccccctctctgagtccacttagggagactcagcttgccagaagagctggagcgatactgatggcgcgagggaggc

SEQ ID NO: 5788 - DNA, 385 bp, Artificial Sequence
  source: /note="Description of Artificial Sequence: Synthetic polynucleotide"
gccttgccagcccgctcagtatcgctcgagcgatagcagaggcctctccagggggacactgtgcatgtctggtccctgagcagccccccacgtccccagtcctgggggcccctggcacagctgtctggaccctccctgttccctgggaagctcctcctgacagccccgcctccagttccaggtgtggttattgtcagggggtgtcagactgtggtggatacagctatgtatcgctcgagcgatagtcgactggttcgacccctggggccagggaaccctggtcaccgtctcctcaggtgagtcctcaccaccccctctctgagtccacttagggagactcagcttgccagtatcgctcgagcgatactgatggcgcgagggaggc

SEQ ID NO: 5789 - DNA, 385 bp, Artificial Sequence
  source: /note="Description of Artificial Sequence: Synthetic polynucleotide"
gccttgccagcccgctcagtcagatgcgagcgatagcagaggcctctccagggggacacagtgcatgtctggtccctgagcagcccccaggctctctagcactgggggcccctggcacagctgtctggaccctccctgttccctgggaagctcctcctgacagccccgcctccagttccaggtgtggttattgtcagggggtgccaggccgtggtagagatggctacatcagatgcgagcgatagtcgactggttcgacccctggggccagggaaccctggtcaccgtctcctcaggtgagtcctcaccaccccctctctgagtccacttagggagactcagcttgccagtcagatgcgagcgatactgatggcgcgagggaggc

SEQ ID NO: 5790 - DNA, 383 bp, Artificial Sequence
  source: /note="Description of Artificial Sequence: Synthetic polynucleotide"
gccttgccagcccgctcaggtgtagcagagcgataaggcagctgactcctgacttggacgcctattccagacaccagacagaggggcaggccccccagaaccagggatgaggacgccccgtcaaggccagaaaagaccaagttgtgctgagcccagcaagggaaggtccccaaacaaaccaggaacgtttctgaaggtgtctgtgtcacagtggagtatagcagctgtgtagcagagcgatagtcgactggttcgacccctggggccagggaaccctggtcaccgtctcctcaggtgagtcctcaccaccccctctctgagtccacttagggagactcagcttgccaggtgtagcagagcgatactgatggcgcgagggaggc

SEQ ID NO: 5791 - DNA, 386 bp, Artificial Sequence
  source: /note="Description of Artificial Sequence: Synthetic polynucleotide"
gccttgccagcccgctcagtggcagttgagcgataaggcagctgacccctgacttggacccctattccagacaccagacagaggcgcaggccccccagaaccagggttgagggacgccccgtcaaagccagacaaaaccaaggggtgttgagcccagcaagggaaggcccccaaacagaccaggaggtttctgaaggtgtctgtgtcacagtggggtatagcagcagcttggcagttgagcgatagtcgactggttcgacccctggggccagggaaccctggtcaccgtctcctcaggtgagtcctcaccaccccctctctgagtccacttagggagactcagcttgccagtggcagttgagcgatactgatggcgcgagggaggc

SEQ ID NO: 5792 - DNA, 386 bp, Artificial Sequence
  source: /note="Description of Artificial Sequence: Synthetic polynucleotide"
gccttgccagcccgctcagcagtccaagagcgatatgaggtagctggcctctgtctcggaccccactccagacaccagacagaggggcaggccccccaaaaccagggttgagggatgatccgtcaaggcagacaagaccaaggggcactgaccccagcaagggaaggctcccaaacagacgaggaggtttctgaagctgtctgtatcacagtggggtatagcagtggctcagtccaagagcgatagtcgactggttcgacccctggggccagggaaccctggtcaccgtctcctcaggtgagtcctcaccaccccctctctgagtccacttagggagactcagcttgccagcagtccaagagcgatactgatggcgcgagggaggc

SEQ ID NO: 5793 - DNA, 383 bp, Artificial Sequence
  source: /note="Description of Artificial Sequence: Synthetic polynucleotide"
gccttgccagcccgctcagtacgtacggagcgatacagctggcctctgtctcggacccccattccagacaccagacagagggacaggccccccagaaccagtgttgagggacacccctgtccagggcagccaagtccaagaggcgcgctgagcccagcaagggaaggcccccaaacaaaccaggaggtttctgaagctgtctgtgtcacagtcgggtatagcagcgtacgtacggagcgatagtcgactggttcgacccctggggccagggaaccctggtcaccgtctcctcaggtgagtcctcaccaccccctctctgagtccacttagggagactcagcttgccagtacgtacggagcgatactgatggcgcgagggaggc

SEQ ID NO: 5794 - DNA, 377 bp, Artificial Sequence
  source: /note="Description of Artificial Sequence: Synthetic polynucleotide"
gccttgccagcccgctcagagtaccgagagcgataagggttgagggctggggtctcccacgtgttttggggctaacagcggaagggagagcactggcaaaggtgctgggggtcccctgaacccgacccgccctgagaccgcagccacatcagcccccagccccacaggccccctaccagccgcagggtttttggctgagctgagaaccactgtgctaactagtaccgagagcgatagtcgactggttcgacccctggggccagggaaccctggtcaccgtctcctcaggtgagtcctcaccaccccctctctgagtccacttagggagactcagcttgccagagtaccgagagcgatactgatggcgcgagggaggc

SEQ ID NO: 5795 - DNA, 382 bp, Artificial Sequence
  source: /note="Description of Artificial Sequence: Synthetic polynucleotide"
gccttgccagcccgctcaggacactctgcatctgagccccggtctctgtgggtgttccgctaactggggctcccagtgctcaccccacaactaaagcgagccccagcctccagagcccccgaaggagatgccgcccacaagcccagcccccatccaggaggccccagagctcagggcgccggggcagattctgaacagccccgagtcacggtgggtacaactggagacactctgcatctgagtcgactactactactactacatggacgtctggggcaaagggaccacggtcaccgtctcctcaggtaagaatggccactctagggcctttgttttctgctactgccgacactctgcatctgactgatggcgcgagggaggc

SEQ ID NO: 5796 - DNA, 382 bp, Artificial Sequence
  source: /note="Description of Artificial Sequence: Synthetic polynucleotide"
gccttgccagcccgctcagttcggaacgcatctgaggcctcggtctctgtgggtgttccgctagctggggctcacagtgctcaccccacacctaaaacgagccacagcctcagagcccctgaaggagaccccgcccacaagcccagcccccacccaggaggccccagagcacagggcgccccgtcggattctgaacagccccgagtcacagtgggtataactggattcggaacgcatctgagtcgactactactactactacatggacgtctggggcaaagggaccacggtcaccgtctcctcaggtaagaatggccactctagggcctttgttttctgctactgccttcggaacgcatctgactgatggcgcgagggaggc

SEQ ID NO: 5797 - DNA, 382 bp, Artificial Sequence
  source: /note="Description of Artificial Sequence: Synthetic polynucleotide"
gccttgccagcccgctcagaagtaacggcatctgaggcctcggtctctgtgggtgttccgctagctggggctcacagtgctcaccccacacctaaaatgagccacagcctccggagcccccgcagagaccccgcccacaagcccagcccccacccaggaggccccagagctcagggcgccccgtcggattccgaacagccccgagtcacagcgggtataaccggaaagtaacggcatctgagtcgactactactactactacatggacgtctggggcaaagggaccacggtcaccgtctcctcaggtaagaatggccactctagggcctttgttttctgctactgccaagtaacggcatctgactgatggcgcgagggaggc

SEQ ID NO: 5798 - DNA, 382 bp, Artificial Sequence
  source: /note="Description of Artificial Sequence: Synthetic polynucleotide"
gccttgccagcccgctcaggtctcctagcatctgagtctctgtgggtgttccgctagctggggcccccagtgctcaccccacacctaaagcgagccccagcctccagagccccctaagcattccccgcccagcagcccagcccctgcccccacccaggaggccccagagctcagggcgcctggtcggattctgaacagccccgagtcacagtgggtataactggagtctcctagcatctgagtcgactactactactactacatggacgtctggggcaaagggaccacggtcaccgtctcctcaggtaagaatggccactctagggcctttgttttctgctactgccgtctcctagcatctgactgatggcgcgagggaggc

SEQ ID NO: 5799 - DNA, 385 bp, Artificial Sequence
  source: /note="Description of Artificial Sequence: Synthetic polynucleotide"
gccttgccagcccgctcagagagtgtcgcatctgaaggcctcaggctctgtgggtgccgctagctggggctgccagtcctcaccccacacctaaggtgagccacagccgccagagcctccacaggagaccccacccagcagcccagcccctacccaggaggccccagagctcagggcgcctgggtggattctgaacagccccgagtcacggtgggtatagtgggagctagagtgtcgcatctgagtcgactactactactactacatggacgtctggggcaaagggaccacggtcaccgtctcctcaggtaagaatggccactctagggcctttgttttctgctactgccagagtgtcgcatctgactgatggcgcgagggaggc

SEQ ID NO: 5800 - DNA, 396 bp, Artificial Sequence
  source: /note="Description of Artificial Sequence: Synthetic polynucleotide"
gccttgccagcccgctcaggttccgaagcatctgaaaaggaggagccccctgtacagcactgggctcagagtcctctcccacacaccctgagtttcagacaaaaaccccctggaaatcatagtatcagcaggagaactagccagagacagcaagaggggactcagtgactcccgcggggacaggaggattttgtgggggctcgtgtcactgtgaggatattgtagtagtaccagctgctgttccgaagcatctgagtcgactactactactactacatggacgtctggggcaaagggaccacggtcaccgtctcctcaggtaagaatggccactctagggcctttgttttctgctactgccgttccgaagcatctgactgatggcgcgagggaggc

SEQ ID NO: 5801 - DNA, 396 bp, Artificial Sequence
  source: /note="Description of Artificial Sequence: Synthetic polynucleotide"
gccttgccagcccgctcagcgttacttgcatctgaaaaggaggagccccttgttcagcactgggctcagagtcctctccaagacacccagagtttcagacaaaaaccccctggaatgcacagtctcagcaggagagccagccagagccagcaagatggggctcagtgacacccgcagggacaggaggattttgtgggggctcgtgtcactgtgaggatattgtactaatggtgtatgctcgttacttgcatctgagtcgactactactactactacatggacgtctggggcaaagggaccacggtcaccgtctcctcaggtaagaatggccactctagggcctttgttttctgctactgcccgttacttgcatctgactgatggcgcgagggaggc

SEQ ID NO: 5802 - DNA, 396 bp, Artificial Sequence
  source: /note="Description of Artificial Sequence: Synthetic polynucleotide"
gccttgccagcccgctcagtaggagacgcatctgaaaaggaggagccccctatacagcactgggctcagagtcctctctgagacaccctgagtttcagacaacaacccgctggaatgcacagtctcagcaggagaacagaccaaagccagcaaaagggacctcggtgacaccagtagggacaggaggattttgtgggggctcgtgtcactgtgaggatattgtagtggtggtagctgcttaggagacgcatctgagtcgactactactactactacatggacgtctggggcaaagggaccacggtcaccgtctcctcaggtaagaatggccactctagggcctttgttttctgctactgcctaggagacgcatctgactgatggcgcgagggaggc

SEQ ID NO: 5803 - DNA, 393 bp, Artificial Sequence
  source: /note="Description of Artificial Sequence: Synthetic polynucleotide"
gccttgccagcccgctcaggtgtctacgcatctgaagccccctgtacagcactgggctcagagtcctctctgagacaggctcagtttcagacaacaacccgctggaatgcacagtctcagcaggagagccaggccagagccagcaagaggagactcggtgacaccagtctcctgtagggacaggaggattttgtgggggttcgtgtcactgtgagcatattgtggtggtgactgctgtgtctacgcatctgagtcgactactactactactacatggacgtctggggcaaagggaccacggtcaccgtctcctcaggtaagaatggccactctagggcctttgttttctgctactgccgtgtctacgcatctgactgatggcgcgagggaggc

SEQ ID NO: 5804 - DNA, 396 bp, Artificial Sequence
  source: /note="Description of Artificial Sequence: Synthetic polynucleotide"
gccttgccagcccgctcagtgctacacgcatctgagtgggcacggacactgtccacctaagccaggggcagacccgagtgtccccgcagtagacctgagagcgctgggcccacagcctcccctcggtgccctgctacctcctcaggtcagccctggacatcccgggtttccccaggctggcggtaggtttggggtgaggtctgtgtcactgtggtattacgatttttggagtggttatttgctacacgcatctgagtcgactactactactactacatggacgtctggggcaaagggaccacggtcaccgtctcctcaggtaagaatggccactctagggcctttgttttctgctactgcctgctacacgcatctgactgatggcgcgagggaggc

SEQ ID NO: 5805 - DNA, 396 bp, Artificial Sequence
  source: /note="Description of Artificial Sequence: Synthetic polynucleotide"
gccttgccagcccgctcagaactgccagcatctgatgggcacggacactatccacataagcgagggatagacccgagtgtccccacagcagacctgagagcgctgggcccacagcctcccctcagagccctgctgcctcctccggtcagccctggacatcccaggtttccccaggcctgccggtaggtttagaatgaggtctgtgtcactgtggtattacgatattttgactggttattaactgccagcatctgagtcgactactactactactacatggacgtctggggcaaagggaccacggtcaccgtctcctcaggtaagaatggccactctagggcctttgttttctgctactgccaactgccagcatctgactgatggcgcgagggaggc

SEQ ID NO: 5806 - DNA, 396 bp, Artificial Sequence
  source: /note="Description of Artificial Sequence: Synthetic polynucleotide"
gccttgccagcccgctcagttggactggcatctgacgatattttgactggttattataaccacagtgtcacagagtccatcaaaaacccatgcctggaagcttcccgccacagccctccccatggggccctgctgcctcctcaggtcagccccggacatcccgggtttccccaggctgggcggtaggtttggggtgaggtctgtgtcactgtggtattactatggttcggggagttattttggactggcatctgagtcgactactactactactacatggacgtctggggcaaagggaccacggtcaccgtctcctcaggtaagaatggccactctagggcctttgttttctgctactgccttggactggcatctgactgatggcgcgagggaggc

SEQ ID NO: 5807 - DNA, 402 bp, Artificial Sequence
  source: /note="Description of Artificial Sequence: Synthetic polynucleotide"
gccttgccagcccgctcaggtagacacgcatctgatggacgcggacactatccacataagcgagggacagacccgagtgttcctgcagtagacctgagagcgctgggcccacagcctcccctcggtgccctgctgcctcctcaggtcagccctggacatcccgggtttccccaggccagatggtaggtttgaagtgaggtctgtgtcactgtggtattatgattacgtttgggggagttatcgttgtagacacgcatctgagtcgactactactactactacatggacgtctggggcaaagggaccacggtcaccgtctcctcaggtaagaatggccactctagggcctttgttttctgctactgccgtagacacgcatctgactgatggcgcgagggaggc

SEQ ID NO: 5808 - DNA, 396 bp, Artificial Sequence
  source: /note="Description of Artificial Sequence: Synthetic polynucleotide"
gccttgccagcccgctcagcactgtacgcatctgatgggcatggacagtgtccacctaagcgagggacagacccgagtgtccctgcagtagacctgagagcgctgggcccacagcctcccctcggggccctgctgcctcctcaggtcagccctggacatcccgggtttccccaggcctggcggtaggtttgaagtgaggtctgtgtcactgtggtattactatgatagtagtggttattcactgtacgcatctgagtcgactactactactactacatggacgtctggggcaaagggaccacggtcaccgtctcctcaggtaagaatggccactctagggcctttgttttctgctactgcccactgtacgcatctgactgatggcgcgagggaggc

SEQ ID NO: 5809 - DNA, 381 bp, Artificial Sequence
  source: /note="Description of Artificial Sequence: Synthetic polynucleotide"
gccttgccagcccgctcaggatgatccgcatctgacaagggtgagtcagaccctcctgccctcgatggcaggcggagaagattcagaaaggtctgagatccccaggacgcagcaccactgtcaatgggggccccagacgcctggaccagggcctgcgtgggaaaggcctctgggcacactcaggggctttttgtgaagggtcctcctactgtgtgactacagtagatgatccgcatctgagtcgactactactactactacatggacgtctggggcaaagggaccacggtcaccgtctcctcaggtaagaatggccactctagggcctttgttttctgctactgccgatgatccgcatctgactgatggcgcgagggaggc

SEQ ID NO: 5810 - DNA, 381 bp, Artificial Sequence
  source: /note="Description of Artificial Sequence: Synthetic polynucleotide"
gccttgccagcccgctcagcgccaatagcatctgatgcctctctccccagtggacaccctcttccaggacagtcctcagtggcatcacagcggcctgagatccccaggacgcagcaccgctgtcaataggggccccaaatgcctggaccagggcctgcgtgggaaaggtctctggccacactcgggctttttgtgaagggccctcctgctgtgtgactacagtacgccaatagcatctgagtcgactactactactactacatggacgtctggggcaaagggaccacggtcaccgtctcctcaggtaagaatggccactctagggcctttgttttctgctactgcccgccaatagcatctgactgatggcgcgagggaggc

SEQ ID NO: 5811 - DNA, 381 bp, Artificial Sequence
  source: /note="Description of Artificial Sequence: Synthetic polynucleotide"
gccttgccagcccgctcagtcaagcctgcatctgaggagggtgagtcagacccacctgccctcgatggcaggcggggaagattcagaaaggcctgagatccccaggacgcagcaccactgtcaatgggggccccagacgcctggaccagggcctgcgtgggaaaggccgctgggcacactcaggggctttttgtgaaggcccctcctactgtgtgactacggtgtcaagcctgcatctgagtcgactactactactactacatggacgtctggggcaaagggaccacggtcaccgtctcctcaggtaagaatggccactctagggcctttgttttctgctactgcctcaagcctgcatctgactgatggcgcgagggaggc

SEQ ID NO: 5812 - DNA, 384 bp, Artificial Sequence
  source: /note="Description of Artificial Sequence: Synthetic polynucleotide"
gccttgccagcccgctcagacgtgtgtgcatctgaggagggtgagtcagacccacctgccctcaatggcaggcggggaagattcagaaaggcctgagatccccaggacgcagcaccactgtcaatgggggccccagacgcctggaccagggcctgtgtgggaaaggcctctggccacactcaggggctttttgtgaagggccctcctgctgtgtgactacggtggtaacgtgtgtgcatctgagtcgactactactactactacatggacgtctggggcaaagggaccacggtcaccgtctcctcaggtaagaatggccactctagggcctttgttttctgctactgccacgtgtgtgcatctgactgatggcgcgagggaggc

SEQ ID NO: 5813 - DNA, 385 bp, Artificial Sequence
  source: /note="Description of Artificial Sequence: Synthetic polynucleotide"
gccttgccagcccgctcagtccgtctagcatctgaagaggcctctccagggggacactgtgcatgtctggtccctgagcagccccccatgtccccagtcctggggggccccctggcacagctgtctggaccctctctattccctgggaagctcctcctgacagccccgcctccagttccaggtgtggttattgtcagggggtgtcagactgtggtggatacagctatgtccgtctagcatctgagtcgactactactactactacatggacgtctggggcaaagggaccacggtcaccgtctcctcaggtaagaatggccactctagggcctttgttttctgctactgcctccgtctagcatctgactgatggcgcgagggaggc

SEQ ID NO: 5814 - DNA, 388 bp, Artificial Sequence
  source: /note="Description of Artificial Sequence: Synthetic polynucleotide"
gccttgccagcccgctcagaagagctggcatctgagcagaggcctctccagggagacactgtgcatgtctggtacctaagcagccccccacgtccccagtcctgggggcccctggctcagctgtctggaccctccctgttccctgggaagctcctcctgacagccccgcctccagttccaggtgtggttattgtcaggcgatgtcagactgtggtggatatagtggctacgaagagctggcatctgagtcgactactactactactacatggacgtctggggcaaagggaccacggtcaccgtctcctcaggtaagaatggccactctagggcctttgttttctgctactgccaagagctggcatctgactgatggcgcgagggaggc

SEQ ID NO: 5815 - DNA, 385 bp, Artificial Sequence
  source: /note="Description of Artificial Sequence: Synthetic polynucleotide"
gccttgccagcccgctcagtatcgctcgcatctgagcagaggcctctccagggggacactgtgcatgtctggtccctgagcagccccccacgtccccagtcctgggggcccctggcacagctgtctggaccctccctgttccctgggaagctcctcctgacagccccgcctccagttccaggtgtggttattgtcagggggtgtcagactgtggtggatacagctatgtatcgctcgcatctgagtcgactactactactactacatggacgtctggggcaaagggaccacggtcaccgtctcctcaggtaagaatggccactctagggcctttgttttctgctactgcctatcgctcgcatctgactgatggcgcgagggaggc

SEQ ID NO: 5816 - DNA, 385 bp, Artificial Sequence
  source: /note="Description of Artificial Sequence: Synthetic polynucleotide"
gccttgccagcccgctcagtcagatgcgcatctgagcagaggcctctccagggggacacagtgcatgtctggtccctgagcagcccccaggctctctagcactgggggcccctggcacagctgtctggaccctccctgttccctgggaagctcctcctgacagccccgcctccagttccaggtgtggttattgtcagggggtgccaggccgtggtagagatggctacatcagatgcgcatctgagtcgactactactactactacatggacgtctggggcaaagggaccacggtcaccgtctcctcaggtaagaatggccactctagggcctttgttttctgctactgcctcagatgcgcatctgactgatggcgcgagggaggc

SEQ ID NO: 5817 - DNA, 383 bp, Artificial Sequence
  source: /note="Description of Artificial Sequence: Synthetic polynucleotide"
gccttgccagcccgctcaggtgtagcagcatctgaaggcagctgactcctgacttggacgcctattccagacaccagacagaggggcaggccccccagaaccagggatgaggacgccccgtcaaggccagaaaagaccaagttgtgctgagcccagcaagggaaggtccccaaacaaaccaggaacgtttctgaaggtgtctgtgtcacagtggagtatagcagctgtgtagcagcatctgagtcgactactactactactacatggacgtctggggcaaagggaccacggtcaccgtctcctcaggtaagaatggccactctagggcctttgttttctgctactgccgtgtagcagcatctgactgatggcgcgagggaggc

SEQ ID NO: 5818 - DNA, 386 bp, Artificial Sequence
  source: /note="Description of Artificial Sequence: Synthetic polynucleotide"
gccttgccagcccgctcagtggcagttgcatctgaaggcagctgacccctgacttggacccctattccagacaccagacagaggcgcaggccccccagaaccagggttgagggacgccccgtcaaagccagacaaaaccaaggggtgttgagcccagcaagggaaggcccccaaacagaccaggaggtttctgaaggtgtctgtgtcacagtggggtatagcagcagcttggcagttgcatctgagtcgactactactactactacatggacgtctggggcaaagggaccacggtcaccgtctcctcaggtaagaatggccactctagggcctttgttttctgctactgcctggcagttgcatctgactgatggcgcgagggaggc

SEQ ID NO: 5819 - DNA, 386 bp, Artificial Sequence
  source: /note="Description of Artificial Sequence: Synthetic polynucleotide"
gccttgccagcccgctcagcagtccaagcatctgatgaggtagctggcctctgtctcggaccccactccagacaccagacagaggggcaggccccccaaaaccagggttgagggatgatccgtcaaggcagacaagaccaaggggcactgaccccagcaagggaaggctcccaaacagacgaggaggtttctgaagctgtctgtatcacagtggggtatagcagtggctcagtccaagcatctgagtcgactactactactactacatggacgtctggggcaaagggaccacggtcaccgtctcctcaggtaagaatggccactctagggcctttgttttctgctactgcccagtccaagcatctgactgatggcgcgagggaggc

SEQ ID NO: 5820 - DNA, 383 bp, Artificial Sequence
  source: /note="Description of Artificial Sequence: Synthetic polynucleotide"
gccttgccagcccgctcagtacgtacggcatctgacagctggcctctgtctcggacccccattccagacaccagacagagggacaggccccccagaaccagtgttgagggacacccctgtccagggcagccaagtccaagaggcgcgctgagcccagcaagggaaggcccccaaacaaaccaggaggtttctgaagctgtctgtgtcacagtcgggtatagcagcgtacgtacggcatctgagtcgactactactactactacatggacgtctggggcaaagggaccacggtcaccgtctcctcaggtaagaatggccactctagggcctttgttttctgctactgcctacgtacggcatctgactgatggcgcgagggaggc

SEQ ID NO: 5821 - DNA, 377 bp, Artificial Sequence
  source: /note="Description of Artificial Sequence: Synthetic polynucleotide"
gccttgccagcccgctcagagtaccgagcatctgaagggttgagggctggggtctcccacgtgttttggggctaacagcggaagggagagcactggcaaaggtgctgggggtcccctgaacccgacccgccctgagaccgcagccacatcagcccccagccccacaggccccctaccagccgcagggtttttggctgagctgagaaccactgtgctaactagtaccgagcatctgagtcgactactactactactacatggacgtctggggcaaagggaccacggtcaccgtctcctcaggtaagaatggccactctagggcctttgttttctgctactgccagtaccgagcatctgactgatggcgcgagggaggc

SEQ ID NO: 5822 - DNA, 495 bp, Artificial Sequence
  source: /note="Description of Artificial Sequence: Synthetic polynucleotide"
gccttgccagcccgctcagtaggagacgacactctggtcctgggcccagtctgtgctgactcagccaccctcggtgtctgaagcccccaggcagagggtcaccatctcctgttctggaagcagctccaacatcggaaataatgctgtaaactggtaccagcagctcccaggaaaggctcccaaactcctcatctattatgatgatctgctgccctcaggggtctctgaccgattctctggctccaagtctggcacctcagcctccctggccatcagtgggctccagtctgaggatgaggctgattattactgtgcagcatgggatgacagcctgatgataggagacgacactctgtcgactcttcggaactgggaccaaggtcaccgtcctaggtaagtggctctcaacctttcccagcctgtctcaccctctgctgtccctggaaaatctgttttctcttaggagacgacactctctgatggcgcgagggaggc

SEQ ID NO: 5823 - DNA, 495 bp, Artificial Sequence
  source: /note="Description of Artificial Sequence: Synthetic polynucleotide"
gccttgccagcccgctcaggtgtctacgacactctcctgggcccagtctgtcgtgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgatgagtgtctacgacactctgtcgactcttcggaactgggaccaaggtcaccgtcctaggtaagtggctctcaacctttcccagcctgtctcaccctctgctgtccctggaaaatctgttttctctgtgtctacgacactctctgatggcgcgagggaggc

SEQ ID NO: 5824 - DNA, 495 bp, Artificial Sequence
  source: /note="Description of Artificial Sequence: Synthetic polynucleotide"
gccttgccagcccgctcaggtacagtggacactctggtcctgggcccagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgatgagtacagtggacactctgtcgactcttcggaactgggaccaaggtcaccgtcctaggtaagtggctctcaacctttcccagcctgtctcaccctctgctgtccctggaaaatctgttttctctgtacagtggacactctctgatggcgcgagggaggc

SEQ ID NO: 5825 - DNA, 495 bp, Artificial Sequence
  source: /note="Description of Artificial Sequence: Synthetic polynucleotide"
gccttgccagcccgctcagggatcatcgacactctggtcctgggcccagtctgtgctgactcagccaccctcagcgtctgggacccccgggcagagggtcaccatctcttgttctggaagcagctccaacatcggaagtaattatgtatactggtaccagcagctcccaggaacggcccccaaactcctcatctatagtaataatcagcggccctcaggggtccctgaccgattctctggctccaagtctggcacctcagcctccctggccatcagtgggctccggtccgaggatgaggctgattattactgtgcagcatgggatgacagcctgatgaggatcatcgacactctgtcgactcttcggaactgggaccaaggtcaccgtcctaggtaagtggctctcaacctttcccagcctgtctcaccctctgctgtccctggaaaatctgttttctctggatcatcgacactctctgatggcgcgagggaggc

SEQ ID NO: 5826 - DNA, 495 bp, Artificial Sequence
  source: /note="Description of Artificial Sequence: Synthetic polynucleotide"
gccttgccagcccgctcagtattggcggacactctcctgggcccagtctgtgctgacgcagccgccctcagtgtctggggccccagggcagagggtcaccatctcctgcactgggagcagctccaacattggggcgggttatgttgtacattggtaccagcagcttccaggaacagcccccaaactcctcatctatggtaacagcaatcggccctcaggggtccctgaccaattctctggctccaagtctggcacctcagcctccctggccatcactggactccagtctgaggatgaggctgattattactgcaaagcatgggataacagcctgatgatattggcggacactctgtcgactcttcggaactgggaccaaggtcaccgtcctaggtaagtggctctcaacctttcccagcctgtctcaccctctgctgtccctggaaaatctgttttctcttattggcggacactctctgatggcgcgagggaggc

SEQ ID NO: 5827 - DNA, 495 bp, Artificial Sequence
  source: /note="Description of Artificial Sequence: Synthetic polynucleotide"
gccttgccagcccgctcagaggcttgagacactctggtcctgggcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgatgaaggcttgagacactctgtcgactcttcggaactgggaccaaggtcaccgtcctaggtaagtggctctcaacctttcccagcctgtctcaccctctgctgtccctggaaaatctgttttctctaggcttgagacactctctgatggcgcgagggaggc

SEQ ID NO: 5828 - DNA, 495 bp, Artificial Sequence
  source: /note="Description of Artificial Sequence: Synthetic polynucleotide"
gccttgccagcccgctcagacacacgtgacactctgtcctgggcccagtctgccctgactcagcctccctccgcgtccaggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaatgaacacacgtgacactctgtcgactcttcggaactgggaccaaggtcaccgtcctaggtaagtggctctcaacctttcccagcctgtctcaccctctgctgtccctggaaaatctgttttctctacacacgtgacactctctgatggcgcgagggaggc

SEQ ID NO: 5829 - DNA, 495 bp, Artificial Sequence
  source: /note="Description of Artificial Sequence: Synthetic polynucleotide"
gccttgccagcccgctcagtagacggagacactctatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctatgatagacggagacactctgtcgactcttcggaactgggaccaaggtcaccgtcctaggtaagtggctctcaacctttcccagcctgtctcaccctctgctgtccctggaaaatctgttttctcttagacggagacactctctgatggcgcgagggaggc

SEQ ID NO: 5830 - DNA, 495 bp, Artificial Sequence
  source: /note="Description of Artificial Sequence: Synthetic polynucleotide"
gccttgccagcccgctcagcagctcttgacactctgtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgaccatctctgggctccaggctgaggacgaggctgattattactgcagctcatatacaagcagcagtgacagctcttgacactctgtcgactcttcggaactgggaccaaggtcaccgtcctaggtaagtggctctcaacctttcccagcctgtctcaccctctgctgtccctggaaaatctgttttctctcagctcttgacactctctgatggcgcgagggaggc

SEQ ID NO: 5831 - DNA, 495 bp, Artificial Sequence
  source: /note="Description of Artificial Sequence: Synthetic polynucleotide"
gccttgccagcccgctcaggagcgatagacactctatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaggtcagtaatcggccctcaggggtccctgatcgcttctctgggtccaagtctggcaacacggcctccctgaccacctctgggctccaggctgaggacgaggctgattattactgcagctcatatacaagcagcagtgagagcgatagacactctgtcgactcttcggaactgggaccaaggtcaccgtcctaggtaagtggctctcaacctttcccagcctgtctcaccctctgctgtccctggaaaatctgttttctctgagcgatagacactctctgatggcgcgagggaggc

SEQ ID NO: 5832 - DNA, 495 bp, Artificial Sequence
  source: /note="Description of Artificial Sequence: Synthetic polynucleotide"
gccttgccagcccgctcaggcatctgagacactctgtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagtgagcatctgagacactctgtcgactcttcggaactgggaccaaggtcaccgtcctaggtaagtggctctcaacctttcccagcctgtctcaccctctgctgtccctggaaaatctgttttctctgcatctgagacactctctgatggcgcgagggaggc

SEQ ID NO: 5833 - DNA, 495 bp, Artificial Sequence
  source: /note="Description of Artificial Sequence: Synthetic polynucleotide"
gccttgccagcccgctcagtgctacacgacactctgtcctgggcccagtctgccctgactcagcctccttttgtgtccggggctcctggacagtcggtcaccatctcctgcactggaaccagcagtgacgttggggattatgatcatgtcttctggtaccaaaagcgtctcagcactacctccagactcctgatttacaatgtcaatactcggccttcagggatctctgacctcttctcaggctccaagtctggcaacatggcttccctgaccatctctgggctcaagtccgaggttgaggctaattatcactgcagcttatattcaagtagttatgatgctacacgacactctgtcgactcttcggaactgggaccaaggtcaccgtcctaggtaagtggctctcaacctttcccagcctgtctcaccctctgctgtccctggaaaatctgttttctcttgctacacgacactctctgatggcgcgagggaggc

SEQ ID NO: 5834 - DNA, 495 bp, Artificial Sequence
  source: /note="Description of Artificial Sequence: Synthetic polynucleotide"
gccttgccagcccgctcagaactgccagacactctctctcctgtaggatccgtggcctcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagtgaaactgccagacactctgtcgactcttcggaactgggaccaaggtcaccgtcctaggtaagtggctctcaacctttcccagcctgtctcaccctctgctgtccctggaaaatctgttttctctaactgccagacactctctgatggcgcgagggaggc

SEQ ID NO: 5835 - DNA, 495 bp, Artificial Sequence
  source: /note="Description of Artificial Sequence: Synthetic polynucleotide"
gccttgccagcccgctcagttggactggacactctttttcttgcaggttctgtggcctcctatgagctgactcagccactctcagtgtcagtggccctgggacaggcggccaggattacctgtgggggaaacaaccttggatataaaaatgtgcactggtaccagcagaagccaggccaggcccctgtgctggtcatctatagggataacaaccggccctctgggatccctgagcgattctctggctccaactcggggaacacggccaccctgaccatcagcagagcccaagccggggatgaggctgactattactgtcaggtgtgggacagcagtgattggactggacactctgtcgactcttcggaactgggaccaaggtcaccgtcctaggtaagtggctctcaacctttcccagcctgtctcaccctctgctgtccctggaaaatctgttttctctttggactggacactctctgatggcgcgagggaggc

SEQ ID NO: 5836 - DNA, 495 bp, Artificial Sequence
  source: /note="Description of Artificial Sequence: Synthetic polynucleotide"
gccttgccagcccgctcaggtagacacgacactctttgcagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctatgaggacagcaaacgaccctccgggatccctgagagattctctggctccagctcagggacaatggccaccttgactatcagtggggcccaggtggaggatgaagctgactactactgttactcaacagacagcagtggtatgagtagacacgacactctgtcgactcttcggaactgggaccaaggtcaccgtcctaggtaagtggctctcaacctttcccagcctgtctcaccctctgctgtccctggaaaatctgttttctctgtagacacgacactctctgatggcgcgagggaggc

SEQ ID NO: 5837 - DNA, 495 bp, Artificial Sequence
  source: /note="Description of Artificial Sequence: Synthetic polynucleotide"
gccttgccagcccgctcagcactgtacgacactctttgcaggctctgcgacctcctatgagctgactcagccacactcagtgtcagtggccacagcacagatggccaggatcacctgtgggggaaacaacattggaagtaaagctgtgcactggtaccagcaaaagccaggccaggaccctgtgctggtcatctatagcgatagcaaccggccctcagggatccctgagcgattctctggctccaacccagggaacaccgccaccctaaccatcagcaggatcgaggctggggatgaggctgactattactgtcaggtgtgggacagtagtagtgtgacactgtacgacactctgtcgactcttcggaactgggaccaaggtcaccgtcctaggtaagtggctctcaacctttcccagcctgtctcaccctctgctgtccctggaaaatctgttttctctcactgtacgacactctctgatggcgcgagggaggc

SEQ ID NO: 5838 - DNA, 495 bp, Artificial Sequence
  source: /note="Description of Artificial Sequence: Synthetic polynucleotide"
gccttgccagcccgctcaggatgatccgacactctttgcaggctctgaggcctcctatgagctgacacagccaccctcggtgtcagtgtccctaggacagatggccaggatcacctgctctggagaagcattgccaaaaaaatatgcttattggtaccagcagaagccaggccagttccctgtgctggtgatatataaagacagcgagaggccctcagggatccctgagcgattctctggctccagctcagggacaatagtcacattgaccatcagtggagtccaggcagaagacgaggctgactattactgtctatcagcagacagcagtggtatgagatgatccgacactctgtcgactcttcggaactgggaccaaggtcaccgtcctaggtaagtggctctcaacctttcccagcctgtctcaccctctgctgtccctggaaaatctgttttctctgatgatccgacactctctgatggcgcgagggaggc

SEQ ID NO: 5839 - DNA, 495 bp, Artificial Sequence
  source: /note="Description of Artificial Sequence: Synthetic polynucleotide"
gccttgccagcccgctcagcgccaatagacactctttgcaggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtggtatgacgccaatagacactctgtcgactcttcggaactgggaccaaggtcaccgtcctaggtaagtggctctcaacctttcccagcctgtctcaccctctgctgtccctggaaaatctgttttctctcgccaatagacactctctgatggcgcgagggaggc

SEQ ID NO: 5840 - DNA, 495 bp, Artificial Sequence
  source: /note="Description of Artificial Sequence: Synthetic polynucleotide"
gccttgccagcccgctcagtcaagcctgacactctttgcaggctctgtgacctcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggacagtagtagtgtgatcaagcctgacactctgtcgactcttcggaactgggaccaaggtcaccgtcctaggtaagtggctctcaacctttcccagcctgtctcaccctctgctgtccctggaaaatctgttttctcttcaagcctgacactctctgatggcgcgagggaggc

SEQ ID NO: 5841 - DNA, 495 bp, Artificial Sequence
  source: /note="Description of Artificial Sequence: Synthetic polynucleotide"
gccttgccagcccgctcagacgtgtgtgacactctcctctcttgcaggctctgttgcctcctatgagctgacacagctaccctcggtgtcagtgtccccaggacagaaagccaggatcacctgctctggagatgtactggggaaaaattatgctgactggtaccagcagaagccaggccaggcccctgagttggtgatatacgaagatagtgagcggtaccctggaatccctgaacgattctctgggtccacctcagggaacacgaccaccctgaccatcagcagggtcctgaccgaagacgaggctgactattactgtttgtctgggaatgaggtgaacgtgtgtgacactctgtcgactcttcggaactgggaccaaggtcaccgtcctaggtaagtggctctcaacctttcccagcctgtctcaccctctgctgtccctggaaaatctgttttctctacgtgtgtgacactctctgatggcgcgagggaggc

SEQ ID NO: 5842 - DNA, 495 bp, Artificial Sequence
  source: /note="Description of Artificial Sequence: Synthetic polynucleotide"
gccttgccagcccgctcagtccgtctagacactctttgcaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagatgaggctgactattactgtcaatcagcagacagcagtggtatgatccgtctagacactctgtcgactcttcggaactgggaccaaggtcaccgtcctaggtaagtggctctcaacctttcccagcctgtctcaccctctgctgtccctggaaaatctgttttctcttccgtctagacactctctgatggcgcgagggaggc

SEQ ID NO: 5843 - DNA, 495 bp, Artificial Sequence
  source: /note="Description of Artificial Sequence: Synthetic polynucleotide"
gccttgccagcccgctcagaagagctggacactctcttttcttgcagtctctgtggcctcctatgagctgacacagccatcctcagtgtcagtgtctccgggacagacagccaggatcacctgctcaggagatgtactggcaaaaaaatatgctcggtggttccagcagaagccaggccaggcccctgtgctggtgatttataaagacagtgagcggccctcagggatccctgagcgattctccggctccagctcagggaccacagtcaccttgaccatcagcggggcccaggttgaggatgaggctgactattactgttactctgcggctgacatgaaagagctggacactctgtcgactcttcggaactgggaccaaggtcaccgtcctaggtaagtggctctcaacctttcccagcctgtctcaccctctgctgtccctggaaaatctgttttctctaagagctggacactctctgatggcgcgagggaggc

SEQ ID NO: 5844 - DNA, 495 bp, Artificial Sequence
  source: /note="Description of Artificial Sequence: Synthetic polynucleotide"
gccttgccagcccgctcagtatcgctcgacactcttgctgactcagcccccgtctgcatctgccttgctgggagcctcgatcaagctcacctgcaccctaagcagtgagcacagcacctacaccatcgaatggtatcaacagagaccagggaggtccccccagtatataatgaaggttaagagtgatggcagccacagcaagggggacgggatccccgatcgcttcatgggctccagttctggggctgaccgctacctcaccttctccaacctccagtctgacgatgaggctgagtatcactgtggagagagccacacgattgatggccaagtcgtgatatcgctcgacactctgtcgactcttcggaactgggaccaaggtcaccgtcctaggtaagtggctctcaacctttcccagcctgtctcaccctctgctgtccctggaaaatctgttttctcttatcgctcgacactctctgatggcgcgagggaggc

SEQ ID NO: 5845 - DNA, 495 bp, Artificial Sequence
  source: /note="Description of Artificial Sequence: Synthetic polynucleotide"
gccttgccagcccgctcagtcagatgcgacactctctctctcccagcctgtgctgactcaatcatcctctgcctctgcttccctgggatcctcggtcaagctcacctgcactctgagcagtgggcacagtagctacatcatcgcatggcatcagcagcagccagggaaggcccctcggtacttgatgaagcttgaaggtagtggaagctacaacaaggggagcggagttcctgatcgcttctcaggctccagctctggggctgaccgctacctcaccatctccaacctccagtttgaggatgaggctgattattactgtgagacctgggacagtatgatcagatgcgacactctgtcgactcttcggaactgggaccaaggtcaccgtcctaggtaagtggctctcaacctttcccagcctgtctcaccctctgctgtccctggaaaatctgttttctcttcagatgcgacactctctgatggcgcgagggaggc

SEQ ID NO: 5846 - DNA, 495 bp, Artificial Sequence
  source: /note="Description of Artificial Sequence: Synthetic polynucleotide"
gccttgccagcccgctcaggtgtagcagacactctctctctcccagcttgtgctgactcaatcgccctctgcctctgcctccctgggagcctcggtcaagctcacctgcactctgagcagtgggcacagcagctacgccatcgcatggcatcagcagcagccagagaagggccctcggtacttgatgaagcttaacagtgatggcagccacagcaagggggacgggatccctgatcgcttctcaggctccagctctggggctgagcgctacctcaccatctccagcctccagtctgaggatgaggctgactattactgtcagacctggggcactgtgagtgtagcagacactctgtcgactcttcggaactgggaccaaggtcaccgtcctaggtaagtggctctcaacctttcccagcctgtctcaccctctgctgtccctggaaaatctgttttctctgtgtagcagacactctctgatggcgcgagggaggc

SEQ ID NO: 5847 - DNA, 495 bp, Artificial Sequence
  source: /note="Description of Artificial Sequence: Synthetic polynucleotide"
gccttgccagcccgctcagtggcagttgacactcttgtgctgactcagccaccttcctcctccgcatctcctggagaatccgccagactcacctgcaccttgcccagtgacatcaatgttggtagctacaacatatactggtaccagcagaagccagggagccctcccaggtatctcctgtactactactcagactcagataagggccagggctctggagtccccagccgcttctctggatccaaagatgcttcagccaatacagggattttactcatctccgggctccagtctgaggatgaggctgactattactgtatgatttggccaagcaatgatggcagttgacactctgtcgactcttcggaactgggaccaaggtcaccgtcctaggtaagtggctctcaacctttcccagcctgtctcaccctctgctgtccctggaaaatctgttttctcttggcagttgacactctctgatggcgcgagggaggc

SEQ ID NO: 5848 - DNA, 495 bp, Artificial Sequence
  source: /note="Description of Artificial Sequence: Synthetic polynucleotide"
gccttgccagcccgctcagcagtccaagacactcttgtgctgactcagccaacctccctctcagcatctcctggagcatcagccagattcacctgcaccttgcgcagcggcatcaatgttggtacctacaggatatactggtaccagcagaatccagggagtcttccccggtatctcctgaggtacaaatcagactcagataagcagcagggctctggagtccccagccgcttctctggatccaaagatgcttcaaccaatgcaggccttttactcatctctgggctccagtctgaagatgaggctgactattactgtgccatttggtacagcagtgacagtccaagacactctgtcgactcttcggaactgggaccaaggtcaccgtcctaggtaagtggctctcaacctttcccagcctgtctcaccctctgctgtccctggaaaatctgttttctctcagtccaagacactctctgatggcgcgagggaggc

SEQ ID NO: 5849 - DNA, 495 bp, Artificial Sequence
  source: /note="Description of Artificial Sequence: Synthetic polynucleotide"
gccttgccagcccgctcagtacgtacggacactcttgtgctgactcagccgtcttccctctctgcatctcctggagcatcagccagtctcacctgcaccttgcgcagtggcatcaatgttggtacctacaggatatactggtaccagcagaagccagggagtcctccccagtatctcctgaggtacaaatcagactcagataagcagcagggctctggagtccccagccgcttctctggatccaaagatgcttcggccaatgcagggattttactcatctctgggctccagtctgaggatgaggctgactattactgtatgatttggcacagcagtgatacgtacggacactctgtcgactcttcggaactgggaccaaggtcaccgtcctaggtaagtggctctcaacctttcccagcctgtctcaccctctgctgtccctggaaaatctgttttctcttacgtacggacactctctgatggcgcgagggaggc

SEQ ID NO: 5850 - DNA, 495 bp, Artificial Sequence
  source: /note="Description of Artificial Sequence: Synthetic polynucleotide"
gccttgccagcccgctcagagtaccgagacactcttgactcagccatcttcccattctgcatcttctggagcatcagtcagactcacctgcatgctgagcagtggcttcagtgttggggacttctggataaggtggtaccaacaaaagccagggaaccctccccggtatctcctgtactaccactcagactccaataagggccaaggctctggagttcccagccgcttctctggatccaacgatgcatcagccaatgcagggattctgcgtatctctgggctccagcctgaggatgaggctgactattactgtggtacatggcacagcaactctatgaagtaccgagacactctgtcgactcttcggaactgggaccaaggtcaccgtcctaggtaagtggctctcaacctttcccagcctgtctcaccctctgctgtccctggaaaatctgttttctctagtaccgagacactctctgatggcgcgagggaggc

SEQ ID NO: 5851 - DNA, 495 bp, Artificial Sequence
  source: /note="Description of Artificial Sequence: Synthetic polynucleotide"
gccttgccagcccgctcagatccatgggacactctagggtccaattctcagactgtggtgactcaggagccctcactgactgtgtccccaggagggacagtcactctcacctgtgcttccagcactggagcagtcaccagtggttactatccaaactggttccagcagaaacctggacaagcacccagggcactgatttatagtacaagcaacaaacactcctggacccctgcccggttctcaggctccctccttgggggcaaagctgccctgacactgtcaggtgtgcagcctgaggacgaggctgagtattactgcctgctctactatggtggtgaatccatgggacactctgtcgactcttcggaactgggaccaaggtcaccgtcctaggtaagtggctctcaacctttcccagcctgtctcaccctctgctgtccctggaaaatctgttttctctatccatgggacactctctgatggcgcgagggaggc

SEQ ID NO: 5852 - DNA, 495 bp, Artificial Sequence
  source: /note="Description of Artificial Sequence: Synthetic polynucleotide"
gccttgccagcccgctcaggtagcagtgacactctagggtccaattcccaggctgtggtgactcaggagccctcactgactgtgtccccaggagggacagtcactctcacctgtggctccagcactggagctgtcaccagtggtcattatccctactggttccagcagaagcctggccaagcccccaggacactgatttatgatacaagcaacaaacactcctggacacctgcccggttctcaggctccctccttgggggcaaagctgccctgacccttttgggtgcgcagcctgaggatgaggctgagtattactgcttgctctcctatagtggtgagtagcagtgacactctgtcgactcttcggaactgggaccaaggtcaccgtcctaggtaagtggctctcaacctttcccagcctgtctcaccctctgctgtccctggaaaatctgttttctctgtagcagtgacactctctgatggcgcgagggaggc

SEQ ID NO: 5853 - DNA, 495 bp, Artificial Sequence
  source: /note="Description of Artificial Sequence: Synthetic polynucleotide"
gccttgccagcccgctcagatcttcgtgacactctgagtggattctcagactgtggtgacccaggagccatcgttctcagtgtcccctggagggacagtcacactcacttgtggcttgagctctggctcagtctctactagttactaccccagctggtaccagcagaccccaggccaggctccacgcacgctcatctacagcacaaacactcgctcttctggggtccctgattgcttctctggctccatccttgggaacaaagctgccctcaccatcacgggggcccaggcagatgatgaatctgattattactgtgtgctgtatatgggtagtgtgaatcttcgtgacactctgtcgactcttcggaactgggaccaaggtcaccgtcctaggtaagtggctctcaacctttcccagcctgtctcaccctctgctgtccctggaaaatctgttttctctatcttcgtgacactctctgatggcgcgagggaggc

SEQ ID NO: 5854 - DNA, 495 bp, Artificial Sequence
  source: /note="Description of Artificial Sequence: Synthetic polynucleotide"
gccttgccagcccgctcagtccacagtgacactcttgactcagccaccttctgcatcagcctccctgggagcctcggtcacactcacctgcaccctgagcagcggctacagtaattataaagtggactggtaccagcagagaccagggaagggcccccggtttgtgatgcgagtgggcactggtgggattgtgggatccaagggggatggcatccctgatcgcttctcagtcttgggctcaggcctgaatcggtacctgaccatcaagaacatccaggaagaagatgagagtgactaccactgtggggcagaccatggcagtgggagcaacttcgtgatccacagtgacactctgtcgactcttcggaactgggaccaaggtcaccgtcctaggtaagtggctctcaacctttcccagcctgtctcaccctctgctgtccctggaaaatctgttttctcttccacagtgacactctctgatggcgcgagggaggc

SEQ ID NO: 5855 - DNA, 495 bp, Artificial Sequence
  source: /note="Description of Artificial Sequence: Synthetic polynucleotide"
gccttgccagcccgctcagatgacaccgacactcttgtcagtggtccaggcagggctgactcagccaccctcggtctccaagggcttgagacagaccgccacactcacctgcactgggaacagcaacaatgttggcaaccaaggagcagcttggcctgagcagcaccagggccaccctcccaaactcctatcctacaggaataacaaccggccctcagggatctcagagagattatctgcatccaggtcaggaaacacagcctccctgaccattactggactccagcctgaggacgaggctgactattactgctcagcatgggacagcagcctcatgaatgacaccgacactctgtcgactcttcggaactgggaccaaggtcaccgtcctaggtaagtggctctcaacctttcccagcctgtctcaccctctgctgtccctggaaaatctgttttctctatgacaccgacactctctgatggcgcgagggaggc

SEQ ID NO: 5856 - DNA, 495 bp, Artificial Sequence
  source: /note="Description of Artificial Sequence: Synthetic polynucleotide"
gccttgccagcccgctcagcttcacgagacactctcgtgctgactcagccgccctctctgtctgcatccccgggagcaacagccagactcccctgcaccctgagcagtgacctcagtgttggtggtaaaaacatgttctggtaccagcagaagccagggagctctcccaggttattcctgtatcactactcagactcagacaagcagctgggacctggggtccccagtcgagtctctggctccaaggagacctcaagtaacacagcgtttttgctcatctctgggctccagcctgaggacgaggccgattattactgccaggtgtacgaaagtagtgacttcacgagacactctgtcgactcttcggaactgggaccaaggtcaccgtcctaggtaagtggctctcaacctttcccagcctgtctcaccctctgctgtccctggaaaatctgttttctctcttcacgagacactctctgatggcgcgagggaggc

SEQ ID NO: 5857 - DNA, 495 bp, Artificial Sequence
  source: /note="Description of Artificial Sequence: Synthetic polynucleotide"
gccttgccagcccgctcagtaggagacttcggaacggtcctgggcccagtctgtgctgactcagccaccctcggtgtctgaagcccccaggcagagggtcaccatctcctgttctggaagcagctccaacatcggaaataatgctgtaaactggtaccagcagctcccaggaaaggctcccaaactcctcatctattatgatgatctgctgccctcaggggtctctgaccgattctctggctccaagtctggcacctcagcctccctggccatcagtgggctccagtctgaggatgaggctgattattactgtgcagcatgggatgacagcctgatgataggagacttcggaacgtcgactattcggcggagggaccaagctgaccgtcctaggtgagtctcttctcccctctccttccccgctcttgggacaatttctgctgtttttgtttgtttctgttaggagacttcggaacctgatggcgcgagggaggc

SEQ ID NO: 5858 - DNA, 495 bp, Artificial Sequence
  source: /note="Description of Artificial Sequence: Synthetic polynucleotide"
gccttgccagcccgctcaggtgtctacttcggaaccctgggcccagtctgtcgtgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgatgagtgtctacttcggaacgtcgactattcggcggagggaccaagctgaccgtcctaggtgagtctcttctcccctctccttccccgctcttgggacaatttctgctgtttttgtttgtttctgtgtgtctacttcggaacctgatggcgcgagggaggc

SEQ ID NO: 5859 - DNA, 495 bp, Artificial Sequence
  source: /note="Description of Artificial Sequence: Synthetic polynucleotide"
gccttgccagcccgctcaggtacagtgttcggaacggtcctgggcccagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgatgagtacagtgttcggaacgtcgactattcggcggagggaccaagctgaccgtcctaggtgagtctcttctcccctctccttccccgctcttgggacaatttctgctgtttttgtttgtttctgtgtacagtgttcggaacctgatggcgcgagggaggc

SEQ ID NO: 5860 - DNA, 495 bp, Artificial Sequence
  source: /note="Description of Artificial Sequence: Synthetic polynucleotide"
gccttgccagcccgctcagggatcatcttcggaacggtcctgggcccagtctgtgctgactcagccaccctcagcgtctgggacccccgggcagagggtcaccatctcttgttctggaagcagctccaacatcggaagtaattatgtatactggtaccagcagctcccaggaacggcccccaaactcctcatctatagtaataatcagcggccctcaggggtccctgaccgattctctggctccaagtctggcacctcagcctccctggccatcagtgggctccggtccgaggatgaggctgattattactgtgcagcatgggatgacagcctgatgaggatcatcttcggaacgtcgactattcggcggagggaccaagctgaccgtcctaggtgagtctcttctcccctctccttccccgctcttgggacaatttctgctgtttttgtttgtttctgtggatcatcttcggaacctgatggcgcgagggaggc

SEQ ID NO: 5861 - DNA, 495 bp, Artificial Sequence
  source: /note="Description of Artificial Sequence: Synthetic polynucleotide"
gccttgccagcccgctcagtattggcgttcggaaccctgggcccagtctgtgctgacgcagccgccctcagtgtctggggccccagggcagagggtcaccatctcctgcactgggagcagctccaacattggggcgggttatgttgtacattggtaccagcagcttccaggaacagcccccaaactcctcatctatggtaacagcaatcggccctcaggggtccctgaccaattctctggctccaagtctggcacctcagcctccctggccatcactggactccagtctgaggatgaggctgattattactgcaaagcatgggataacagcctgatgatattggcgttcggaacgtcgactattcggcggagggaccaagctgaccgtcctaggtgagtctcttctcccctctccttccccgctcttgggacaatttctgctgtttttgtttgtttctgttattggcgttcggaacctgatggcgcgagggaggc

SEQ ID NO: 5862 - DNA, 495 bp, Artificial Sequence
  source: /note="Description of Artificial Sequence: Synthetic polynucleotide"
gccttgccagcccgctcagaggcttgattcggaacggtcctgggcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgatgaaggcttgattcggaacgtcgactattcggcggagggaccaagctgaccgtcctaggtgagtctcttctcccctctccttccccgctcttgggacaatttctgctgtttttgtttgtttctgtaggcttgattcggaacctgatggcgcgagggaggc

SEQ ID NO: 5863 - DNA, 495 bp, Artificial Sequence
  source: /note="Description of Artificial Sequence: Synthetic polynucleotide"
gccttgccagcccgctcagacacacgtttcggaacgtcctgggcccagtctgccctgactcagcctccctccgcgtccaggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaatgaacacacgtttcggaacgtcgactattcggcggagggaccaagctgaccgtcctaggtgagtctcttctcccctctccttccccgctcttgggacaatttctgctgtttttgtttgtttctgtacacacgtttcggaacctgatggcgcgagggaggc

SEQ ID NO: 5864 - DNA, 495 bp, Artificial Sequence
  source: /note="Description of Artificial Sequence: Synthetic polynucleotide"
gccttgccagcccgctcagtagacggattcggaacatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctatgatagacggattcggaacgtcgactattcggcggagggaccaagctgaccgtcctaggtgagtctcttctcccctctccttccccgctcttgggacaatttctgctgtttttgtttgtttctgttagacggattcggaacctgatggcgcgagggaggc

SEQ ID NO: 5865 - DNA, 495 bp, Artificial Sequence
  source: /note="Description of Artificial Sequence: Synthetic polynucleotide"
gccttgccagcccgctcagcagctcttttcggaacgtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgaccatctctgggctccaggctgaggacgaggctgattattactgcagctcatatacaagcagcagtgacagctcttttcggaacgtcgactattcggcggagggaccaagctgaccgtcctaggtgagtctcttctcccctctccttccccgctcttgggacaatttctgctgtttttgtttgtttctgtcagctcttttcggaacctgatggcgcgagggaggc

SEQ ID NO: 5866 - DNA, 495 bp, Artificial Sequence
  source: /note="Description of Artificial Sequence: Synthetic polynucleotide"
gccttgccagcccgctcaggagcgatattcggaacatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaggtcagtaatcggccctcaggggtccctgatcgcttctctgggtccaagtctggcaacacggcctccctgaccacctctgggctccaggctgaggacgaggctgattattactgcagctcatatacaagcagcagtgagagcgatattcggaacgtcgactattcggcggagggaccaagctgaccgtcctaggtgagtctcttctcccctctccttccccgctcttgggacaatttctgctgtttttgtttgtttctgtgagcgatattcggaacctgatggcgcgagggaggc

SEQ ID NO: 5867 - DNA, 495 bp, Artificial Sequence
  source: /note="Description of Artificial Sequence: Synthetic polynucleotide"
gccttgccagcccgctcaggcatctgattcggaacgtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagtgagcatctgattcggaacgtcgactattcggcggagggaccaagctgaccgtcctaggtgagtctcttctcccctctccttccccgctcttgggacaatttctgctgtttttgtttgtttctgtgcatctgattcggaacctgatggcgcgagggaggc

SEQ ID NO: 5868 - DNA, 495 bp, Artificial Sequence
  source: /note="Description of Artificial Sequence: Synthetic polynucleotide"
gccttgccagcccgctcagtgctacacttcggaacgtcctgggcccagtctgccctgactcagcctccttttgtgtccggggctcctggacagtcggtcaccatctcctgcactggaaccagcagtgacgttggggattatgatcatgtcttctggtaccaaaagcgtctcagcactacctccagactcctgatttacaatgtcaatactcggccttcagggatctctgacctcttctcaggctccaagtctggcaacatggcttccctgaccatctctgggctcaagtccgaggttgaggctaattatcactgcagcttatattcaagtagttatgatgctacacttcggaacgtcgactattcggcggagggaccaagctgaccgtcctaggtgagtctcttctcccctctccttccccgctcttgggacaatttctgctgtttttgtttgtttctgttgctacacttcggaacctgatggcgcgagggaggc

SEQ ID NO: 5869 - DNA, 495 bp, Artificial Sequence
  source: /note="Description of Artificial Sequence: Synthetic polynucleotide"
gccttgccagcccgctcagaactgccattcggaacctctcctgtaggatccgtggcctcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagtgaaactgccattcggaacgtcgactattcggcggagggaccaagctgaccgtcctaggtgagtctcttctcccctctccttccccgctcttgggacaatttctgctgtttttgtttgtttctgtaactgccattcggaacctgatggcgcgagggaggc

SEQ ID NO: 5870 - DNA, 495 bp, Artificial Sequence
  source: /note="Description of Artificial Sequence: Synthetic polynucleotide"
gccttgccagcccgctcagttggactgttcggaacttttcttgcaggttctgtggcctcctatgagctgactcagccactctcagtgtcagtggccctgggacaggcggccaggattacctgtgggggaaacaaccttggatataaaaatgtgcactggtaccagcagaagccaggccaggcccctgtgctggtcatctatagggataacaaccggccctctgggatccctgagcgattctctggctccaactcggggaacacggccaccctgaccatcagcagagcccaagccggggatgaggctgactattactgtcaggtgtgggacagcagtgattggactgttcggaacgtcgactattcggcggagggaccaagctgaccgtcctaggtgagtctcttctcccctctccttccccgctcttgggacaatttctgctgtttttgtttgtttctgtttggactgttcggaacctgatggcgcgagggaggc

SEQ ID NO: 5871 - DNA, 495 bp, Artificial Sequence
  source: /note="Description of Artificial Sequence: Synthetic polynucleotide"
gccttgccagcccgctcaggtagacacttcggaacttgcagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctatgaggacagcaaacgaccctccgggatccctgagagattctctggctccagctcagggacaatggccaccttgactatcagtggggcccaggtggaggatgaagctgactactactgttactcaacagacagcagtggtatgagtagacacttcggaacgtcgactattcggcggagggaccaagctgaccgtcctaggtgagtctcttctcccctctccttccccgctcttgggacaatttctgctgtttttgtttgtttctgtgtagacacttcggaacctgatggcgcgagggaggc

SEQ ID NO: 5872 - DNA, 495 bp, Artificial Sequence
  source: /note="Description of Artificial Sequence: Synthetic polynucleotide"
gccttgccagcccgctcagcactgtacttcggaacttgcaggctctgcgacctcctatgagctgactcagccacactcagtgtcagtggccacagcacagatggccaggatcacctgtgggggaaacaacattggaagtaaagctgtgcactggtaccagcaaaagccaggccaggaccctgtgctggtcatctatagcgatagcaaccggccctcagggatccctgagcgattctctggctccaacccagggaacaccgccaccctaaccatcagcaggatcgaggctggggatgaggctgactattactgtcaggtgtgggacagtagtagtgtgacactgtacttcggaacgtcgactattcggcggagggaccaagctgaccgtcctaggtgagtctcttctcccctctccttccccgctcttgggacaatttctgctgtttttgtttgtttctgtcactgtacttcggaacctgatggcgcgagggaggc

SEQ ID NO: 5873 - DNA, 495 bp, Artificial Sequence
  source: /note="Description of Artificial Sequence: Synthetic polynucleotide"
gccttgccagcccgctcaggatgatccttcggaacttgcaggctctgaggcctcctatgagctgacacagccaccctcggtgtcagtgtccctaggacagatggccaggatcacctgctctggagaagcattgccaaaaaaatatgcttattggtaccagcagaagccaggccagttccctgtgctggtgatatataaagacagcgagaggccctcagggatccctgagcgattctctggctccagctcagggacaatagtcacattgaccatcagtggagtccaggcagaagacgaggctgactattactgtctatcagcagacagcagtggtatgagatgatccttcggaacgtcgactattcggcggagggaccaagctgaccgtcctaggtgagtctcttctcccctctccttccccgctcttgggacaatttctgctgtttttgtttgtttctgtgatgatccttcggaacctgatggcgcgagggaggc

SEQ ID NO: 5874 - DNA, 495 bp, Artificial Sequence
  source: /note="Description of Artificial Sequence: Synthetic polynucleotide"
gccttgccagcccgctcagcgccaatattcggaacttgcaggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtggtatgacgccaatattcggaacgtcgactattcggcggagggaccaagctgaccgtcctaggtgagtctcttctcccctctccttccccgctcttgggacaatttctgctgtttttgtttgtttctgtcgccaatattcggaacctgatggcgcgagggaggc

SEQ ID NO: 5875 - DNA, 495 bp, Artificial Sequence
  source: /note="Description of Artificial Sequence: Synthetic polynucleotide"
gccttgccagcccgctcagtcaagcctttcggaacttgcaggctctgtgacctcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggacagtagtagtgtgatcaagcctttcggaacgtcgactattcggcggagggaccaagctgaccgtcctaggtgagtctcttctcccctctccttccccgctcttgggacaatttctgctgtttttgtttgtttctgttcaagcctttcggaacctgatggcgcgagggaggc

SEQ ID NO: 5876 - DNA, 495 bp, Artificial Sequence
  source: /note="Description of Artificial Sequence: Synthetic polynucleotide"
gccttgccagcccgctcagacgtgtgtttcggaaccctctcttgcaggctctgttgcctcctatgagctgacacagctaccctcggtgtcagtgtccccaggacagaaagccaggatcacctgctctggagatgtactggggaaaaattatgctgactggtaccagcagaagccaggccaggcccctgagttggtgatatacgaagatagtgagcggtaccctggaatccctgaacgattctctgggtccacctcagggaacacgaccaccctgaccatcagcagggtcctgaccgaagacgaggctgactattactgtttgtctgggaatgaggtgaacgtgtgtttcggaacgtcgactattcggcggagggaccaagctgaccgtcctaggtgagtctcttctcccctctccttccccgctcttgggacaatttctgctgtttttgtttgtttctgtacgtgtgtttcggaacctgatggcgcgagggaggc

SEQ ID NO: 5877 - DNA, 495 bp, Artificial Sequence
  source: /note="Description of Artificial Sequence: Synthetic polynucleotide"
gccttgccagcccgctcagtccgtctattcggaacttgcaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagatgaggctgactattactgtcaatcagcagacagcagtggtatgatccgtctattcggaacgtcgactattcggcggagggaccaagctgaccgtcctaggtgagtctcttctcccctctccttccccgctcttgggacaatttctgctgtttttgtttgtttctgttccgtctattcggaacctgatggcgcgagggaggc

SEQ ID NO: 5878 - DNA, 495 bp, Artificial Sequence
  source: /note="Description of Artificial Sequence: Synthetic polynucleotide"
gccttgccagcccgctcagaagagctgttcggaaccttttcttgcagtctctgtggcctcctatgagctgacacagccatcctcagtgtcagtgtctccgggacagacagccaggatcacctgctcaggagatgtactggcaaaaaaatatgctcggtggttccagcagaagccaggccaggcccctgtgctggtgatttataaagacagtgagcggccctcagggatccctgagcgattctccggctccagctcagggaccacagtcaccttgaccatcagcggggcccaggttgaggatgaggctgactattactgttactctgcggctgacatgaaagagctgttcggaacgtcgactattcggcggagggaccaagctgaccgtcctaggtgagtctcttctcccctctccttccccgctcttgggacaatttctgctgtttttgtttgtttctgtaagagctgttcggaacctgatggcgcgagggaggc

SEQ ID NO: 5879 - DNA, 495 bp, Artificial Sequence
  source: /note="Description of Artificial Sequence: Synthetic polynucleotide"
gccttgccagcccgctcagtatcgctcttcggaactgctgactcagcccccgtctgcatctgccttgctgggagcctcgatcaagctcacctgcaccctaagcagtgagcacagcacctacaccatcgaatggtatcaacagagaccagggaggtccccccagtatataatgaaggttaagagtgatggcagccacagcaagggggacgggatccccgatcgcttcatgggctccagttctggggctgaccgctacctcaccttctccaacctccagtctgacgatgaggctgagtatcactgtggagagagccacacgattgatggccaagtcgtgatatcgctcttcggaacgtcgactattcggcggagggaccaagctgaccgtcctaggtgagtctcttctcccctctccttccccgctcttgggacaatttctgctgtttttgtttgtttctgttatcgctcttcggaacctgatggcgcgagggaggc

SEQ ID NO: 5880 - DNA, 495 bp, Artificial Sequence
  source: /note="Description of Artificial Sequence: Synthetic polynucleotide"
gccttgccagcccgctcagtcagatgcttcggaacctctctcccagcctgtgctgactcaatcatcctctgcctctgcttccctgggatcctcggtcaagctcacctgcactctgagcagtgggcacagtagctacatcatcgcatggcatcagcagcagccagggaaggcccctcggtacttgatgaagcttgaaggtagtggaagctacaacaaggggagcggagttcctgatcgcttctcaggctccagctctggggctgaccgctacctcaccatctccaacctccagtttgaggatgaggctgattattactgtgagacctgggacagtatgatcagatgcttcggaacgtcgactattcggcggagggaccaagctgaccgtcctaggtgagtctcttctcccctctccttccccgctcttgggacaatttctgctgtttttgtttgtttctgttcagatgcttcggaacctgatggcgcgagggaggc

SEQ ID NO: 5881 - DNA, 495 bp, Artificial Sequence
  source: /note="Description of Artificial Sequence: Synthetic polynucleotide"
gccttgccagcccgctcaggtgtagcattcggaacctctctcccagcttgtgctgactcaatcgccctctgcctctgcctccctgggagcctcggtcaagctcacctgcactctgagcagtgggcacagcagctacgccatcgcatggcatcagcagcagccagagaagggccctcggtacttgatgaagcttaacagtgatggcagccacagcaagggggacgggatccctgatcgcttctcaggctccagctctggggctgagcgctacctcaccatctccagcctccagtctgaggatgaggctgactattactgtcagacctggggcactgtgagtgtagcattcggaacgtcgactattcggcggagggaccaagctgaccgtcctaggtgagtctcttctcccctctccttccccgctcttgggacaatttctgctgtttttgtttgtttctgtgtgtagcattcggaacctgatggcgcgagggaggc

SEQ ID NO: 5882 - DNA, 495 bp, Artificial Sequence
  source: /note="Description of Artificial Sequence: Synthetic polynucleotide"
gccttgccagcccgctcagtggcagttttcggaactgtgctgactcagccaccttcctcctccgcatctcctggagaatccgccagactcacctgcaccttgcccagtgacatcaatgttggtagctacaacatatactggtaccagcagaagccagggagccctcccaggtatctcctgtactactactcagactcagataagggccagggctctggagtccccagccgcttctctggatccaaagatgcttcagccaatacagggattttactcatctccgggctccagtctgaggatgaggctgactattactgtatgatttggccaagcaatgatggcagttttcggaacgtcgactattcggcggagggaccaagctgaccgtcctaggtgagtctcttctcccctctccttccccgctcttgggacaatttctgctgtttttgtttgtttctgttggcagttttcggaacctgatggcgcgagggaggc

SEQ ID NO: 5883 - DNA, 495 bp, Artificial Sequence
  source: /note="Description of Artificial Sequence: Synthetic polynucleotide"
gccttgccagcccgctcagcagtccaattcggaactgtgctgactcagccaacctccctctcagcatctcctggagcatcagccagattcacctgcaccttgcgcagcggcatcaatgttggtacctacaggatatactggtaccagcagaatccagggagtcttccccggtatctcctgaggtacaaatcagactcagataagcagcagggctctggagtccccagccgcttctctggatccaaagatgcttcaaccaatgcaggccttttactcatctctgggctccagtctgaagatgaggctgactattactgtgccatttggtacagcagtgacagtccaattcggaacgtcgactattcggcggagggaccaagctgaccgtcctaggtgagtctcttctcccctctccttccccgctcttgggacaatttctgctgtttttgtttgtttctgtcagtccaattcggaacctgatggcgcgagggaggc

SEQ ID NO: 5884 - DNA, 495 bp, Artificial Sequence
  source: /note="Description of Artificial Sequence: Synthetic polynucleotide"
gccttgccagcccgctcagtacgtacgttcggaactgtgctgactcagccgtcttccctctctgcatctcctggagcatcagccagtctcacctgcaccttgcgcagtggcatcaatgttggtacctacaggatatactggtaccagcagaagccagggagtcctccccagtatctcctgaggtacaaatcagactcagataagcagcagggctctggagtccccagccgcttctctggatccaaagatgcttcggccaatgcagggattttactcatctctgggctccagtctgaggatgaggctgactattactgtatgatttggcacagcagtgatacgtacgttcggaacgtcgactattcggcggagggaccaagctgaccgtcctaggtgagtctcttctcccctctccttccccgctcttgggacaatttctgctgtttttgtttgtttctgttacgtacgttcggaacctgatggcgcgagggaggc

SEQ ID NO: 5885 - DNA, 495 bp, Artificial Sequence
  source: /note="Description of Artificial Sequence: Synthetic polynucleotide"
gccttgccagcccgctcagagtaccgattcggaactgactcagccatcttcccattctgcatcttctggagcatcagtcagactcacctgcatgctgagcagtggcttcagtgttggggacttctggataaggtggtaccaacaaaagccagggaaccctccccggtatctcctgtactaccactcagactccaataagggccaaggctctggagttcccagccgcttctctggatccaacgatgcatcagccaatgcagggattctgcgtatctctgggctccagcctgaggatgaggctgactattactgtggtacatggcacagcaactctatgaagtaccgattcggaacgtcgactattcggcggagggaccaagctgaccgtcctaggtgagtctcttctcccctctccttccccgctcttgggacaatttctgctgtttttgtttgtttctgtagtaccgattcggaacctgatggcgcgagggaggc

SEQ ID NO: 5886 - DNA, 495 bp, Artificial Sequence
  source: /note="Description of Artificial Sequence: Synthetic polynucleotide"
gccttgccagcccgctcagatccatggttcggaacagggtccaattctcagactgtggtgactcaggagccctcactgactgtgtccccaggagggacagtcactctcacctgtgcttccagcactggagcagtcaccagtggttactatccaaactggttccagcagaaacctggacaagcacccagggcactgatttatagtacaagcaacaaacactcctggacccctgcccggttctcaggctccctccttgggggcaaagctgccctgacactgtcaggtgtgcagcctgaggacgaggctgagtattactgcctgctctactatggtggtgaatccatggttcggaacgtcgactattcggcggagggaccaagctgaccgtcctaggtgagtctcttctcccctctccttccccgctcttgggacaatttctgctgtttttgtttgtttctgtatccatggttcggaacctgatggcgcgagggaggc

SEQ ID NO: 5887 - DNA, 495 bp, Artificial Sequence
  source: /note="Description of Artificial Sequence: Synthetic polynucleotide"
gccttgccagcccgctcaggtagcagtttcggaacagggtccaattcccaggctgtggtgactcaggagccctcactgactgtgtccccaggagggacagtcactctcacctgtggctccagcactggagctgtcaccagtggtcattatccctactggttccagcagaagcctggccaagcccccaggacactgatttatgatacaagcaacaaacactcctggacacctgcccggttctcaggctccctccttgggggcaaagctgccctgacccttttgggtgcgcagcctgaggatgaggctgagtattactgcttgctctcctatagtggtgagtagcagtttcggaacgtcgactattcggcggagggaccaagctgaccgtcctaggtgagtctcttctcccctctccttccccgctcttgggacaatttctgctgtttttgtttgtttctgtgtagcagtttcggaacctgatggcgcgagggaggc

SEQ ID NO: 5888 - DNA, 495 bp, Artificial Sequence
  source: /note="Description of Artificial Sequence: Synthetic polynucleotide"
gccttgccagcccgctcagatcttcgtttcggaacgagtggattctcagactgtggtgacccaggagccatcgttctcagtgtcccctggagggacagtcacactcacttgtggcttgagctctggctcagtctctactagttactaccccagctggtaccagcagaccccaggccaggctccacgcacgctcatctacagcacaaacactcgctcttctggggtccctgattgcttctctggctccatccttgggaacaaagctgccctcaccatcacgggggcccaggcagatgatgaatctgattattactgtgtgctgtatatgggtagtgtgaatcttcgtttcggaacgtcgactattcggcggagggaccaagctgaccgtcctaggtgagtctcttctcccctctccttccccgctcttgggacaatttctgctgtttttgtttgtttctgtatcttcgtttcggaacctgatggcgcgagggaggc

SEQ ID NO: 5889 - DNA, 495 bp, Artificial Sequence
  source: /note="Description of Artificial Sequence: Synthetic polynucleotide"
gccttgccagcccgctcagtccacagtttcggaactgactcagccaccttctgcatcagcctccctgggagcctcggtcacactcacctgcaccctgagcagcggctacagtaattataaagtggactggtaccagcagagaccagggaagggcccccggtttgtgatgcgagtgggcactggtgggattgtgggatccaagggggatggcatccctgatcgcttctcagtcttgggctcaggcctgaatcggtacctgaccatcaagaacatccaggaagaagatgagagtgactaccactgtggggcagaccatggcagtgggagcaacttcgtgatccacagtttcggaacgtcgactattcggcggagggaccaagctgaccgtcctaggtgagtctcttctcccctctccttccccgctcttgggacaatttctgctgtttttgtttgtttctgttccacagtttcggaacctgatggcgcgagggaggc

SEQ ID NO: 5890 - DNA, 495 bp, Artificial Sequence
  source: /note="Description of Artificial Sequence: Synthetic polynucleotide"
gccttgccagcccgctcagatgacaccttcggaactgtcagtggtccaggcagggctgactcagccaccctcggtctccaagggcttgagacagaccgccacactcacctgcactgggaacagcaacaatgttggcaaccaaggagcagcttggcctgagcagcaccagggccaccctcccaaactcctatcctacaggaataacaaccggccctcagggatctcagagagattatctgcatccaggtcaggaaacacagcctccctgaccattactggactccagcctgaggacgaggctgactattactgctcagcatgggacagcagcctcatgaatgacaccttcggaacgtcgactattcggcggagggaccaagctgaccgtcctaggtgagtctcttctcccctctccttccccgctcttgggacaatttctgctgtttttgtttgtttctgtatgacaccttcggaacctgatggcgcgagggaggc

SEQ ID NO: 5891 - DNA, 495 bp, Artificial Sequence
  source: /note="Description of Artificial Sequence: Synthetic polynucleotide"
gccttgccagcccgctcagcttcacgattcggaaccgtgctgactcagccgccctctctgtctgcatccccgggagcaacagccagactcccctgcaccctgagcagtgacctcagtgttggtggtaaaaacatgttctggtaccagcagaagccagggagctctcccaggttattcctgtatcactactcagactcagacaagcagctgggacctggggtccccagtcgagtctctggctccaaggagacctcaagtaacacagcgtttttgctcatctctgggctccagcctgaggacgaggccgattattactgccaggtgtacgaaagtagtgacttcacgattcggaacgtcgactattcggcggagggaccaagctgaccgtcctaggtgagtctcttctcccctctccttccccgctcttgggacaatttctgctgtttttgtttgtttctgtcttcacgattcggaacctgatggcgcgagggaggc

SEQ ID NO: 5892 - DNA, 495 bp, Artificial Sequence
  source: /note="Description of Artificial Sequence: Synthetic polynucleotide"
gccttgccagcccgctcagtaggagacaagtaacgggtcctgggcccagtctgtgctgactcagccaccctcggtgtctgaagcccccaggcagagggtcaccatctcctgttctggaagcagctccaacatcggaaataatgctgtaaactggtaccagcagctcccaggaaaggctcccaaactcctcatctattatgatgatctgctgccctcaggggtctctgaccgattctctggctccaagtctggcacctcagcctccctggccatcagtgggctccagtctgaggatgaggctgattattactgtgcagcatgggatgacagcctgatgataggagacaagtaacggtcgactgttcggcggagggaccaagctgaccgtcctaggtgagtctcttctcccctctccttccccgctcttgggacaatttctgctgtttttgtttgtttctgttaggagacaagtaacgctgatggcgcgagggaggc

SEQ ID NO: 5893 - DNA, 495 bp, Artificial Sequence
  source: /note="Description of Artificial Sequence: Synthetic polynucleotide"
gccttgccagcccgctcaggtgtctacaagtaacgcctgggcccagtctgtcgtgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgatgagtgtctacaagtaacggtcgactgttcggcggagggaccaagctgaccgtcctaggtgagtctcttctcccctctccttccccgctcttgggacaatttctgctgtttttgtttgtttctgtgtgtctacaagtaacgctgatggcgcgagggaggc

SEQ ID NO: 5894 - DNA, 495 bp, Artificial Sequence
  source: /note="Description of Artificial Sequence: Synthetic polynucleotide"
gccttgccagcccgctcaggtacagtgaagtaacgggtcctgggcccagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgatgagtacagtgaagtaacggtcgactgttcggcggagggaccaagctgaccgtcctaggtgagtctcttctcccctctccttccccgctcttgggacaatttctgctgtttttgtttgtttctgtgtacagtgaagtaacgctgatggcgcgagggaggc

SEQ ID NO: 5895 - DNA, 495 bp, Artificial Sequence
  source: /note="Description of Artificial Sequence: Synthetic polynucleotide"
gccttgccagcccgctcagggatcatcaagtaacgggtcctgggcccagtctgtgctgactcagccaccctcagcgtctgggacccccgggcagagggtcaccatctcttgttctggaagcagctccaacatcggaagtaattatgtatactggtaccagcagctcccaggaacggcccccaaactcctcatctatagtaataatcagcggccctcaggggtccctgaccgattctctggctccaagtctggcacctcagcctccctggccatcagtgggctccggtccgaggatgaggctgattattactgtgcagcatgggatgacagcctgatgaggatcatcaagtaacggtcgactgttcggcggagggaccaagctgaccgtcctaggtgagtctcttctcccctctccttccccgctcttgggacaatttctgctgtttttgtttgtttctgtggatcatcaagtaacgctgatggcgcgagggaggc

SEQ ID NO: 5896 - DNA, 495 bp, Artificial Sequence
  source: /note="Description of Artificial Sequence: Synthetic polynucleotide"
gccttgccagcccgctcagtattggcgaagtaacgcctgggcccagtctgtgctgacgcagccgccctcagtgtctggggccccagggcagagggtcaccatctcctgcactgggagcagctccaacattggggcgggttatgttgtacattggtaccagcagcttccaggaacagcccccaaactcctcatctatggtaacagcaatcggccctcaggggtccctgaccaattctctggctccaagtctggcacctcagcctccctggccatcactggactccagtctgaggatgaggctgattattactgcaaagcatgggataacagcctgatgatattggcgaagtaacggtcgactgttcggcggagggaccaagctgaccgtcctaggtgagtctcttctcccctctccttccccgctcttgggacaatttctgctgtttttgtttgtttctgttattggcgaagtaacgctgatggcgcgagggaggc

SEQ ID NO: 5897 - DNA, 495 bp, Artificial Sequence
  source: /note="Description of Artificial Sequence: Synthetic polynucleotide"
gccttgccagcccgctcagaggcttgaaagtaacgggtcctgggcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgatgaaggcttgaaagtaacggtcgactgttcggcggagggaccaagctgaccgtcctaggtgagtctcttctcccctctccttccccgctcttgggacaatttctgctgtttttgtttgtttctgtaggcttgaaagtaacgctgatggcgcgagggaggc

SEQ ID NO: 5898 - DNA, 495 bp, Artificial Sequence
  source: /note="Description of Artificial Sequence: Synthetic polynucleotide"
gccttgccagcccgctcagacacacgtaagtaacggtcctgggcccagtctgccctgactcagcctccctccgcgtccaggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaatgaacacacgtaagtaacggtcgactgttcggcggagggaccaagctgaccgtcctaggtgagtctcttctcccctctccttccccgctcttgggacaatttctgctgtttttgtttgtttctgtacacacgtaagtaacgctgatggcgcgagggaggc

SEQ ID NO: 5899 - DNA, 495 bp, Artificial Sequence
  source: /note="Description of Artificial Sequence: Synthetic polynucleotide"
gccttgccagcccgctcagtagacggaaagtaacgatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctatgatagacggaaagtaacggtcgactgttcggcggagggaccaagctgaccgtcctaggtgagtctcttctcccctctccttccccgctcttgggacaatttctgctgtttttgtttgtttctgttagacggaaagtaacgctgatggcgcgagggaggc

SEQ ID NO: 5900 - DNA, 495 bp, Artificial Sequence
  source: /note="Description of Artificial Sequence: Synthetic polynucleotide"
gccttgccagcccgctcagcagctcttaagtaacggtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgaccatctctgggctccaggctgaggacgaggctgattattactgcagctcatatacaagcagcagtgacagctcttaagtaacggtcgactgttcggcggagggaccaagctgaccgtcctaggtgagtctcttctcccctctccttccccgctcttgggacaatttctgctgtttttgtttgtttctgtcagctcttaagtaacgctgatggcgcgagggaggc

SEQ ID NO: 5901 - DNA, 495 bp, Artificial Sequence
  source: /note="Description of Artificial Sequence: Synthetic polynucleotide"
gccttgccagcccgctcaggagcgataaagtaacgatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaggtcagtaatcggccctcaggggtccctgatcgcttctctgggtccaagtctggcaacacggcctccctgaccacctctgggctccaggctgaggacgaggctgattattactgcagctcatatacaagcagcagtgagagcgataaagtaacggtcgactgttcggcggagggaccaagctgaccgtcctaggtgagtctcttctcccctctccttccccgctcttgggacaatttctgctgtttttgtttgtttctgtgagcgataaagtaacgctgatggcgcgagggaggc

SEQ ID NO: 5902 - DNA, 495 bp, Artificial Sequence
  source: /note="Description of Artificial Sequence: Synthetic polynucleotide"
gccttgccagcccgctcaggcatctgaaagtaacggtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagtgagcatctgaaagtaacggtcgactgttcggcggagggaccaagctgaccgtcctaggtgagtctcttctcccctctccttccccgctcttgggacaatttctgctgtttttgtttgtttctgtgcatctgaaagtaacgctgatggcgcgagggaggc

SEQ ID NO: 5903 - DNA, 495 bp, Artificial Sequence
  source: /note="Description of Artificial Sequence: Synthetic polynucleotide"
gccttgccagcccgctcagtgctacacaagtaacggtcctgggcccagtctgccctgactcagcctccttttgtgtccggggctcctggacagtcggtcaccatctcctgcactggaaccagcagtgacgttggggattatgatcatgtcttctggtaccaaaagcgtctcagcactacctccagactcctgatttacaatgtcaatactcggccttcagggatctctgacctcttctcaggctccaagtctggcaacatggcttccctgaccatctctgggctcaagtccgaggttgaggctaattatcactgcagcttatattcaagtagttatgatgctacacaagtaacggtcgactgttcggcggagggaccaagctgaccgtcctaggtgagtctcttctcccctctccttccccgctcttgggacaatttctgctgtttttgtttgtttctgttgctacacaagtaacgctgatggcgcgagggaggc

SEQ ID NO: 5904 - DNA, 495 bp, Artificial Sequence
  source: /note="Description of Artificial Sequence: Synthetic polynucleotide"
gccttgccagcccgctcagaactgccaaagtaacgctctcctgtaggatccgtggcctcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagtgaaactgccaaagtaacggtcgactgttcggcggagggaccaagctgaccgtcctaggtgagtctcttctcccctctccttccccgctcttgggacaatttctgctgtttttgtttgtttctgtaactgccaaagtaacgctgatggcgcgagggaggc

SEQ ID NO: 5905 - DNA, 495 bp, Artificial Sequence
  source: /note="Description of Artificial Sequence: Synthetic polynucleotide"
gccttgccagcccgctcagttggactgaagtaacgttttcttgcaggttctgtggcctcctatgagctgactcagccactctcagtgtcagtggccctgggacaggcggccaggattacctgtgggggaaacaaccttggatataaaaatgtgcactggtaccagcagaagccaggccaggcccctgtgctggtcatctatagggataacaaccggccctctgggatccctgagcgattctctggctccaactcggggaacacggccaccctgaccatcagcagagcccaagccggggatgaggctgactattactgtcaggtgtgggacagcagtgattggactgaagtaacggtcgactgttcggcggagggaccaagctgaccgtcctaggtgagtctcttctcccctctccttccccgctcttgggacaatttctgctgtttttgtttgtttctgtttggactgaagtaacgctgatggcgcgagggaggc

SEQ ID NO: 5906 - DNA, 495 bp, Artificial Sequence
  source: /note="Description of Artificial Sequence: Synthetic polynucleotide"
gccttgccagcccgctcaggtagacacaagtaacgttgcagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctatgaggacagcaaacgaccctccgggatccctgagagattctctggctccagctcagggacaatggccaccttgactatcagtggggcccaggtggaggatgaagctgactactactgttactcaacagacagcagtggtatgagtagacacaagtaacggtcgactgttcggcggagggaccaagctgaccgtcctaggtgagtctcttctcccctctccttccccgctcttgggacaatttctgctgtttttgtttgtttctgtgtagacacaagtaacgctgatggcgcgagggaggc

SEQ ID NO: 5907 - DNA, 495 bp, Artificial Sequence
  source: /note="Description of Artificial Sequence: Synthetic polynucleotide"
gccttgccagcccgctcagcactgtacaagtaacgttgcaggctctgcgacctcctatgagctgactcagccacactcagtgtcagtggccacagcacagatggccaggatcacctgtgggggaaacaacattggaagtaaagctgtgcactggtaccagcaaaagccaggccaggaccctgtgctggtcatctatagcgatagcaaccggccctcagggatccctgagcgattctctggctccaacccagggaacaccgccaccctaaccatcagcaggatcgaggctggggatgaggctgactattactgtcaggtgtgggacagtagtagtgtgacactgtacaagtaacggtcgactgttcggcggagggaccaagctgaccgtcctaggtgagtctcttctcccctctccttccccgctcttgggacaatttctgctgtttttgtttgtttctgtcactgtacaagtaacgctgatggcgcgagggaggc

SEQ ID NO: 5908 - DNA, 495 bp, Artificial Sequence
  source: /note="Description of Artificial Sequence: Synthetic polynucleotide"
gccttgccagcccgctcaggatgatccaagtaacgttgcaggctctgaggcctcctatgagctgacacagccaccctcggtgtcagtgtccctaggacagatggccaggatcacctgctctggagaagcattgccaaaaaaatatgcttattggtaccagcagaagccaggccagttccctgtgctggtgatatataaagacagcgagaggccctcagggatccctgagcgattctctggctccagctcagggacaatagtcacattgaccatcagtggagtccaggcagaagacgaggctgactattactgtctatcagcagacagcagtggtatgagatgatccaagtaacggtcgactgttcggcggagggaccaagctgaccgtcctaggtgagtctcttctcccctctccttccccgctcttgggacaatttctgctgtttttgtttgtttctgtgatgatccaagtaacgctgatggcgcgagggaggc

SEQ ID NO: 5909 - DNA, 495 bp, Artificial Sequence
  source: /note="Description of Artificial Sequence: Synthetic polynucleotide"
gccttgccagcccgctcagcgccaataaagtaacgttgcaggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtggtatgacgccaataaagtaacggtcgactgttcggcggagggaccaagctgaccgtcctaggtgagtctcttctcccctctccttccccgctcttgggacaatttctgctgtttttgtttgtttctgtcgccaataaagtaacgctgatggcgcgagggaggc

SEQ ID NO: 5910 - DNA, 495 bp, Artificial Sequence
  source: /note="Description of Artificial Sequence: Synthetic polynucleotide"
gccttgccagcccgctcagtcaagcctaagtaacgttgcaggctctgtgacctcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggacagtagtagtgtgatcaagcctaagtaacggtcgactgttcggcggagggaccaagctgaccgtcctaggtgagtctcttctcccctctccttccccgctcttgggacaatttctgctgtttttgtttgtttctgttcaagcctaagtaacgctgatggcgcgagggaggc

SEQ ID NO: 5911 - DNA, 495 bp, Artificial Sequence
  source: /note="Description of Artificial Sequence: Synthetic polynucleotide"
gccttgccagcccgctcagacgtgtgtaagtaacgcctctcttgcaggctctgttgcctcctatgagctgacacagctaccctcggtgtcagtgtccccaggacagaaagccaggatcacctgctctggagatgtactggggaaaaattatgctgactggtaccagcagaagccaggccaggcccctgagttggtgatatacgaagatagtgagcggtaccctggaatccctgaacgattctctgggtccacctcagggaacacgaccaccctgaccatcagcagggtcctgaccgaagacgaggctgactattactgtttgtctgggaatgaggtgaacgtgtgtaagtaacggtcgactgttcggcggagggaccaagctgaccgtcctaggtgagtctcttctcccctctccttccccgctcttgggacaatttctgctgtttttgtttgtttctgtacgtgtgtaagtaacgctgatggcgcgagggaggc

SEQ ID NO: 5912 - DNA, 495 bp, Artificial Sequence
  source: /note="Description of Artificial Sequence: Synthetic polynucleotide"
gccttgccagcccgctcagtccgtctaaagtaacgttgcaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagatgaggctgactattactgtcaatcagcagacagcagtggtatgatccgtctaaagtaacggtcgactgttcggcggagggaccaagctgaccgtcctaggtgagtctcttctcccctctccttccccgctcttgggacaatttctgctgtttttgtttgtttctgttccgtctaaagtaacgctgatggcgcgagggaggc

SEQ ID NO: 5913 - DNA, 495 bp, Artificial Sequence
  source: /note="Description of Artificial Sequence: Synthetic polynucleotide"
gccttgccagcccgctcagaagagctgaagtaacgcttttcttgcagtctctgtggcctcctatgagctgacacagccatcctcagtgtcagtgtctccgggacagacagccaggatcacctgctcaggagatgtactggcaaaaaaatatgctcggtggttccagcagaagccaggccaggcccctgtgctggtgatttataaagacagtgagcggccctcagggatccctgagcgattctccggctccagctcagggaccacagtcaccttgaccatcagcggggcccaggttgaggatgaggctgactattactgttactctgcggctgacatgaaagagctgaagtaacggtcgactgttcggcggagggaccaagctgaccgtcctaggtgagtctcttctcccctctccttccccgctcttgggacaatttctgctgtttttgtttgtttctgtaagagctgaagtaacgctgatggcgcgagggaggc

SEQ ID NO: 5914 - DNA, 495 bp, Artificial Sequence
  source: /note="Description of Artificial Sequence: Synthetic polynucleotide"
gccttgccagcccgctcagtatcgctcaagtaacgtgctgactcagcccccgtctgcatctgccttgctgggagcctcgatcaagctcacctgcaccctaagcagtgagcacagcacctacaccatcgaatggtatcaacagagaccagggaggtccccccagtatataatgaaggttaagagtgatggcagccacagcaagggggacgggatccccgatcgcttcatgggctccagttctggggctgaccgctacctcaccttctccaacctccagtctgacgatgaggctgagtatcactgtggagagagccacacgattgatggccaagtcgtgatatcgctcaagtaacggtcgactgttcggcggagggaccaagctgaccgtcctaggtgagtctcttctcccctctccttccccgctcttgggacaatttctgctgtttttgtttgtttctgttatcgctcaagtaacgctgatggcgcgagggaggc

SEQ ID NO: 5915 - DNA, 495 bp, Artificial Sequence
  source: /note="Description of Artificial Sequence: Synthetic polynucleotide"
gccttgccagcccgctcagtcagatgcaagtaacgctctctcccagcctgtgctgactcaatcatcctctgcctctgcttccctgggatcctcggtcaagctcacctgcactctgagcagtgggcacagtagctacatcatcgcatggcatcagcagcagccagggaaggcccctcggtacttgatgaagcttgaaggtagtggaagctacaacaaggggagcggagttcctgatcgcttctcaggctccagctctggggctgaccgctacctcaccatctccaacctccagtttgaggatgaggctgattattactgtgagacctgggacagtatgatcagatgcaagtaacggtcgactgttcggcggagggaccaagctgaccgtcctaggtgagtctcttctcccctctccttccccgctcttgggacaatttctgctgtttttgtttgtttctgttcagatgcaagtaacgctgatggcgcgagggaggc

SEQ ID NO: 5916 - DNA, 495 bp, Artificial Sequence
  source: /note="Description of Artificial Sequence: Synthetic polynucleotide"
gccttgccagcccgctcaggtgtagcaaagtaacgctctctcccagcttgtgctgactcaatcgccctctgcctctgcctccctgggagcctcggtcaagctcacctgcactctgagcagtgggcacagcagctacgccatcgcatggcatcagcagcagccagagaagggccctcggtacttgatgaagcttaacagtgatggcagccacagcaagggggacgggatccctgatcgcttctcaggctccagctctggggctgagcgctacctcaccatctccagcctccagtctgaggatgaggctgactattactgtcagacctggggcactgtgagtgtagcaaagtaacggtcgactgttcggcggagggaccaagctgaccgtcctaggtgagtctcttctcccctctccttccccgctcttgggacaatttctgctgtttttgtttgtttctgtgtgtagcaaagtaacgctgatggcgcgagggaggc

SEQ ID NO: 5917 - DNA, 495 bp, Artificial Sequence
  source: /note="Description of Artificial Sequence: Synthetic polynucleotide"
gccttgccagcccgctcagtggcagttaagtaacgtgtgctgactcagccaccttcctcctccgcatctcctggagaatccgccagactcacctgcaccttgcccagtgacatcaatgttggtagctacaacatatactggtaccagcagaagccagggagccctcccaggtatctcctgtactactactcagactcagataagggccagggctctggagtccccagccgcttctctggatccaaagatgcttcagccaatacagggattttactcatctccgggctccagtctgaggatgaggctgactattactgtatgatttggccaagcaatgatggcagttaagtaacggtcgactgttcggcggagggaccaagctgaccgtcctaggtgagtctcttctcccctctccttccccgctcttgggacaatttctgctgtttttgtttgtttctgttggcagttaagtaacgctgatggcgcgagggaggc

SEQ ID NO: 5918 - DNA, 495 bp, Artificial Sequence
  source: /note="Description of Artificial Sequence: Synthetic polynucleotide"
gccttgccagcccgctcagcagtccaaaagtaacgtgtgctgactcagccaacctccctctcagcatctcctggagcatcagccagattcacctgcaccttgcgcagcggcatcaatgttggtacctacaggatatactggtaccagcagaatccagggagtcttccccggtatctcctgaggtacaaatcagactcagataagcagcagggctctggagtccccagccgcttctctggatccaaagatgcttcaaccaatgcaggccttttactcatctctgggctccagtctgaagatgaggctgactattactgtgccatttggtacagcagtgacagtccaaaagtaacggtcgactgttcggcggagggaccaagctgaccgtcctaggtgagtctcttctcccctctccttccccgctcttgggacaatttctgctgtttttgtttgtttctgtcagtccaaaagtaacgctgatggcgcgagggaggc

SEQ ID NO: 5919 - DNA, 495 bp, Artificial Sequence
  source: /note="Description of Artificial Sequence: Synthetic polynucleotide"
gccttgccagcccgctcagtacgtacgaagtaacgtgtgctgactcagccgtcttccctctctgcatctcctggagcatcagccagtctcacctgcaccttgcgcagtggcatcaatgttggtacctacaggatatactggtaccagcagaagccagggagtcctccccagtatctcctgaggtacaaatcagactcagataagcagcagggctctggagtccccagccgcttctctggatccaaagatgcttcggccaatgcagggattttactcatctctgggctccagtctgaggatgaggctgactattactgtatgatttggcacagcagtgatacgtacgaagtaacggtcgactgttcggcggagggaccaagctgaccgtcctaggtgagtctcttctcccctctccttccccgctcttgggacaatttctgctgtttttgtttgtttctgttacgtacgaagtaacgctgatggcgcgagggaggc

SEQ ID NO: 5920 - DNA, 495 bp, Artificial Sequence
  source: /note="Description of Artificial Sequence: Synthetic polynucleotide"
gccttgccagcccgctcagagtaccgaaagtaacgtgactcagccatcttcccattctgcatcttctggagcatcagtcagactcacctgcatgctgagcagtggcttcagtgttggggacttctggataaggtggtaccaacaaaagccagggaaccctccccggtatctcctgtactaccactcagactccaataagggccaaggctctggagttcccagccgcttctctggatccaacgatgcatcagccaatgcagggattctgcgtatctctgggctccagcctgaggatgaggctgactattactgtggtacatggcacagcaactctatgaagtaccgaaagtaacggtcgactgttcggcggagggaccaagctgaccgtcctaggtgagtctcttctcccctctccttccccgctcttgggacaatttctgctgtttttgtttgtttctgtagtaccgaaagtaacgctgatggcgcgagggaggc

SEQ ID NO: 5921 - DNA, 495 bp, Artificial Sequence
  source: /note="Description of Artificial Sequence: Synthetic polynucleotide"
gccttgccagcccgctcagatccatggaagtaacgagggtccaattctcagactgtggtgactcaggagccctcactgactgtgtccccaggagggacagtcactctcacctgtgcttccagcactggagcagtcaccagtggttactatccaaactggttccagcagaaacctggacaagcacccagggcactgatttatagtacaagcaacaaacactcctggacccctgcccggttctcaggctccctccttgggggcaaagctgccctgacactgtcaggtgtgcagcctgaggacgaggctgagtattactgcctgctctactatggtggtgaatccatggaagtaacggtcgactgttcggcggagggaccaagctgaccgtcctaggtgagtctcttctcccctctccttccccgctcttgggacaatttctgctgtttttgtttgtttctgtatccatggaagtaacgctgatggcgcgagggaggc

SEQ ID NO: 5922 - DNA, 495 bp, Artificial Sequence
  source: /note="Description of Artificial Sequence: Synthetic polynucleotide"
gccttgccagcccgctcaggtagcagtaagtaacgagggtccaattcccaggctgtggtgactcaggagccctcactgactgtgtccccaggagggacagtcactctcacctgtggctccagcactggagctgtcaccagtggtcattatccctactggttccagcagaagcctggccaagcccccaggacactgatttatgatacaagcaacaaacactcctggacacctgcccggttctcaggctccctccttgggggcaaagctgccctgacccttttgggtgcgcagcctgaggatgaggctgagtattactgcttgctctcctatagtggtgagtagcagtaagtaacggtcgactgttcggcggagggaccaagctgaccgtcctaggtgagtctcttctcccctctccttccccgctcttgggacaatttctgctgtttttgtttgtttctgtgtagcagtaagtaacgctgatggcgcgagggaggc

SEQ ID NO: 5923 - DNA, 495 bp, Artificial Sequence
  source: /note="Description of Artificial Sequence: Synthetic polynucleotide"
gccttgccagcccgctcagatcttcgtaagtaacggagtggattctcagactgtggtgacccaggagccatcgttctcagtgtcccctggagggacagtcacactcacttgtggcttgagctctggctcagtctctactagttactaccccagctggtaccagcagaccccaggccaggctccacgcacgctcatctacagcacaaacactcgctcttctggggtccctgattgcttctctggctccatccttgggaacaaagctgccctcaccatcacgggggcccaggcagatgatgaatctgattattactgtgtgctgtatatgggtagtgtgaatcttcgtaagtaacggtcgactgttcggcggagggaccaagctgaccgtcctaggtgagtctcttctcccctctccttccccgctcttgggacaatttctgctgtttttgtttgtttctgtatcttcgtaagtaacgctgatggcgcgagggaggc

SEQ ID NO: 5924 - DNA, 495 bp, Artificial Sequence
  source: /note="Description of Artificial Sequence: Synthetic polynucleotide"
gccttgccagcccgctcagtccacagtaagtaacgtgactcagccaccttctgcatcagcctccctgggagcctcggtcacactcacctgcaccctgagcagcggctacagtaattataaagtggactggtaccagcagagaccagggaagggcccccggtttgtgatgcgagtgggcactggtgggattgtgggatccaagggggatggcatccctgatcgcttctcagtcttgggctcaggcctgaatcggtacctgaccatcaagaacatccaggaagaagatgagagtgactaccactgtggggcagaccatggcagtgggagcaacttcgtgatccacagtaagtaacggtcgactgttcggcggagggaccaagctgaccgtcctaggtgagtctcttctcccctctccttccccgctcttgggacaatttctgctgtttttgtttgtttctgttccacagtaagtaacgctgatggcgcgagggaggc

SEQ ID NO: 5925 - DNA, 495 bp, Artificial Sequence
  source: /note="Description of Artificial Sequence: Synthetic polynucleotide"
gccttgccagcccgctcagatgacaccaagtaacgtgtcagtggtccaggcagggctgactcagccaccctcggtctccaagggcttgagacagaccgccacactcacctgcactgggaacagcaacaatgttggcaaccaaggagcagcttggcctgagcagcaccagggccaccctcccaaactcctatcctacaggaataacaaccggccctcagggatctcagagagattatctgcatccaggtcaggaaacacagcctccctgaccattactggactccagcctgaggacgaggctgactattactgctcagcatgggacagcagcctcatgaatgacaccaagtaacggtcgactgttcggcggagggaccaagctgaccgtcctaggtgagtctcttctcccctctccttccccgctcttgggacaatttctgctgtttttgtttgtttctgtatgacaccaagtaacgctgatggcgcgagggaggc

SEQ ID NO: 5926 - DNA, 495 bp, Artificial Sequence
  source: /note="Description of Artificial Sequence: Synthetic polynucleotide"
gccttgccagcccgctcagcttcacgaaagtaacgcgtgctgactcagccgccctctctgtctgcatccccgggagcaacagccagactcccctgcaccctgagcagtgacctcagtgttggtggtaaaaacatgttctggtaccagcagaagccagggagctctcccaggttattcctgtatcactactcagactcagacaagcagctgggacctggggtccccagtcgagtctctggctccaaggagacctcaagtaacacagcgtttttgctcatctctgggctccagcctgaggacgaggccgattattactgccaggtgtacgaaagtagtgacttcacgaaagtaacggtcgactgttcggcggagggaccaagctgaccgtcctaggtgagtctcttctcccctctccttccccgctcttgggacaatttctgctgtttttgtttgtttctgtcttcacgaaagtaacgctgatggcgcgagggaggc

SEQ ID NO: 5927 - DNA, 495 bp, Artificial Sequence
  source: /note="Description of Artificial Sequence: Synthetic polynucleotide"
gccttgccagcccgctcagtaggagacgtctcctaggtcctgggcccagtctgtgctgactcagccaccctcggtgtctgaagcccccaggcagagggtcaccatctcctgttctggaagcagctccaacatcggaaataatgctgtaaactggtaccagcagctcccaggaaaggctcccaaactcctcatctattatgatgatctgctgccctcaggggtctctgaccgattctctggctccaagtctggcacctcagcctccctggccatcagtgggctccagtctgaggatgaggctgattattactgtgcagcatgggatgacagcctgatgataggagacgtctcctagtcgactatttggtggaggaacccagctgatcattttagatgagtctcttcttccctttctttccctgccaagttggtgacaattttattctgatttcgatctttgtaggagacgtctcctactgatggcgcgagggaggc

SEQ ID NO: 5928 - DNA, 495 bp, Artificial Sequence
  source: /note="Description of Artificial Sequence: Synthetic polynucleotide"
gccttgccagcccgctcaggtgtctacgtctcctacctgggcccagtctgtcgtgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgatgagtgtctacgtctcctagtcgactatttggtggaggaacccagctgatcattttagatgagtctcttcttccctttctttccctgccaagttggtgacaattttattctgatttcgatctttggtgtctacgtctcctactgatggcgcgagggaggc

SEQ ID NO: 5929 - DNA, 495 bp, Artificial Sequence
  source: /note="Description of Artificial Sequence: Synthetic polynucleotide"
gccttgccagcccgctcaggtacagtggtctcctaggtcctgggcccagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgatgagtacagtggtctcctagtcgactatttggtggaggaacccagctgatcattttagatgagtctcttcttccctttctttccctgccaagttggtgacaattttattctgatttcgatctttggtacagtggtctcctactgatggcgcgagggaggc

SEQ ID NO: 5930 - DNA, 495 bp, Artificial Sequence
  source: /note="Description of Artificial Sequence: Synthetic polynucleotide"
gccttgccagcccgctcagggatcatcgtctcctaggtcctgggcccagtctgtgctgactcagccaccctcagcgtctgggacccccgggcagagggtcaccatctcttgttctggaagcagctccaacatcggaagtaattatgtatactggtaccagcagctcccaggaacggcccccaaactcctcatctatagtaataatcagcggccctcaggggtccctgaccgattctctggctccaagtctggcacctcagcctccctggccatcagtgggctccggtccgaggatgaggctgattattactgtgcagcatgggatgacagcctgatgaggatcatcgtctcctagtcgactatttggtggaggaacccagctgatcattttagatgagtctcttcttccctttctttccctgccaagttggtgacaattttattctgatttcgatctttgggatcatcgtctcctactgatggcgcgagggaggc

SEQ ID NO: 5931 - DNA, 495 bp, Artificial Sequence
  source: /note="Description of Artificial Sequence: Synthetic polynucleotide"
gccttgccagcccgctcagtattggcggtctcctacctgggcccagtctgtgctgacgcagccgccctcagtgtctggggccccagggcagagggtcaccatctcctgcactgggagcagctccaacattggggcgggttatgttgtacattggtaccagcagcttccaggaacagcccccaaactcctcatctatggtaacagcaatcggccctcaggggtccctgaccaattctctggctccaagtctggcacctcagcctccctggccatcactggactccagtctgaggatgaggctgattattactgcaaagcatgggataacagcctgatgatattggcggtctcctagtcgactatttggtggaggaacccagctgatcattttagatgagtctcttcttccctttctttccctgccaagttggtgacaattttattctgatttcgatctttgtattggcggtctcctactgatggcgcgagggaggc

SEQ ID NO: 5932 - DNA, 495 bp, Artificial Sequence
  source: /note="Description of Artificial Sequence: Synthetic polynucleotide"
gccttgccagcccgctcagaggcttgagtctcctaggtcctgggcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgatgaaggcttgagtctcctagtcgactatttggtggaggaacccagctgatcattttagatgagtctcttcttccctttctttccctgccaagttggtgacaattttattctgatttcgatctttgaggcttgagtctcctactgatggcgcgagggaggc

SEQ ID NO: 5933 - DNA, 495 bp, Artificial Sequence
  source: /note="Description of Artificial Sequence: Synthetic polynucleotide"
gccttgccagcccgctcagacacacgtgtctcctagtcctgggcccagtctgccctgactcagcctccctccgcgtccaggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaatgaacacacgtgtctcctagtcgactatttggtggaggaacccagctgatcattttagatgagtctcttcttccctttctttccctgccaagttggtgacaattttattctgatttcgatctttgacacacgtgtctcctactgatggcgcgagggaggc

SEQ ID NO: 5934 - DNA, 495 bp, Artificial Sequence
  source: /note="Description of Artificial Sequence: Synthetic polynucleotide"
gccttgccagcccgctcagtagacggagtctcctaatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctatgatagacggagtctcctagtcgactatttggtggaggaacccagctgatcattttagatgagtctcttcttccctttctttccctgccaagttggtgacaattttattctgatttcgatctttgtagacggagtctcctactgatggcgcgagggaggc

SEQ ID NO: 5935 - DNA, 495 bp, Artificial Sequence
  source: /note="Description of Artificial Sequence: Synthetic polynucleotide"
gccttgccagcccgctcagcagctcttgtctcctagtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgaccatctctgggctccaggctgaggacgaggctgattattactgcagctcatatacaagcagcagtgacagctcttgtctcctagtcgactatttggtggaggaacccagctgatcattttagatgagtctcttcttccctttctttccctgccaagttggtgacaattttattctgatttcgatctttgcagctcttgtctcctactgatggcgcgagggaggc

SEQ ID NO: 5936 - DNA, 495 bp, Artificial Sequence
  source: /note="Description of Artificial Sequence: Synthetic polynucleotide"
gccttgccagcccgctcaggagcgatagtctcctaatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaggtcagtaatcggccctcaggggtccctgatcgcttctctgggtccaagtctggcaacacggcctccctgaccacctctgggctccaggctgaggacgaggctgattattactgcagctcatatacaagcagcagtgagagcgatagtctcctagtcgactatttggtggaggaacccagctgatcattttagatgagtctcttcttccctttctttccctgccaagttggtgacaattttattctgatttcgatctttggagcgatagtctcctactgatggcgcgagggaggc

SEQ ID NO: 5937 - DNA, 495 bp, Artificial Sequence
  source: /note="Description of Artificial Sequence: Synthetic polynucleotide"
gccttgccagcccgctcaggcatctgagtctcctagtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagtgagcatctgagtctcctagtcgactatttggtggaggaacccagctgatcattttagatgagtctcttcttccctttctttccctgccaagttggtgacaattttattctgatttcgatctttggcatctgagtctcctactgatggcgcgagggaggc

SEQ ID NO: 5938 - DNA, 495 bp, Artificial Sequence
  source: /note="Description of Artificial Sequence: Synthetic polynucleotide"
gccttgccagcccgctcagtgctacacgtctcctagtcctgggcccagtctgccctgactcagcctccttttgtgtccggggctcctggacagtcggtcaccatctcctgcactggaaccagcagtgacgttggggattatgatcatgtcttctggtaccaaaagcgtctcagcactacctccagactcctgatttacaatgtcaatactcggccttcagggatctctgacctcttctcaggctccaagtctggcaacatggcttccctgaccatctctgggctcaagtccgaggttgaggctaattatcactgcagcttatattcaagtagttatgatgctacacgtctcctagtcgactatttggtggaggaacccagctgatcattttagatgagtctcttcttccctttctttccctgccaagttggtgacaattttattctgatttcgatctttgtgctacacgtctcctactgatggcgcgagggaggc

SEQ ID NO: 5939 - DNA, 495 bp, Artificial Sequence
  source: /note="Description of Artificial Sequence: Synthetic polynucleotide"
gccttgccagcccgctcagaactgccagtctcctactctcctgtaggatccgtggcctcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagtgaaactgccagtctcctagtcgactatttggtggaggaacccagctgatcattttagatgagtctcttcttccctttctttccctgccaagttggtgacaattttattctgatttcgatctttgaactgccagtctcctactgatggcgcgagggaggc

SEQ ID NO: 5940 - DNA, 495 bp, Artificial Sequence
  source: /note="Description of Artificial Sequence: Synthetic polynucleotide"
gccttgccagcccgctcagttggactggtctcctattttcttgcaggttctgtggcctcctatgagctgactcagccactctcagtgtcagtggccctgggacaggcggccaggattacctgtgggggaaacaaccttggatataaaaatgtgcactggtaccagcagaagccaggccaggcccctgtgctggtcatctatagggataacaaccggccctctgggatccctgagcgattctctggctccaactcggggaacacggccaccctgaccatcagcagagcccaagccggggatgaggctgactattactgtcaggtgtgggacagcagtgattggactggtctcctagtcgactatttggtggaggaacccagctgatcattttagatgagtctcttcttccctttctttccctgccaagttggtgacaattttattctgatttcgatctttgttggactggtctcctactgatggcgcgagggaggc

SEQ ID NO: 5941 - DNA, 495 bp, Artificial Sequence
  source: /note="Description of Artificial Sequence: Synthetic polynucleotide"
gccttgccagcccgctcaggtagacacgtctcctattgcagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctatgaggacagcaaacgaccctccgggatccctgagagattctctggctccagctcagggacaatggccaccttgactatcagtggggcccaggtggaggatgaagctgactactactgttactcaacagacagcagtggtatgagtagacacgtctcctagtcgactatttggtggaggaacccagctgatcattttagatgagtctcttcttccctttctttccctgccaagttggtgacaattttattctgatttcgatctttggtagacacgtctcctactgatggcgcgagggaggc

SEQ ID NO: 5942 - DNA, 495 bp, Artificial Sequence
  source: /note="Description of Artificial Sequence: Synthetic polynucleotide"
gccttgccagcccgctcagcactgtacgtctcctattgcaggctctgcgacctcctatgagctgactcagccacactcagtgtcagtggccacagcacagatggccaggatcacctgtgggggaaacaacattggaagtaaagctgtgcactggtaccagcaaaagccaggccaggaccctgtgctggtcatctatagcgatagcaaccggccctcagggatccctgagcgattctctggctccaacccagggaacaccgccaccctaaccatcagcaggatcgaggctggggatgaggctgactattactgtcaggtgtgggacagtagtagtgtgacactgtacgtctcctagtcgactatttggtggaggaacccagctgatcattttagatgagtctcttcttccctttctttccctgccaagttggtgacaattttattctgatttcgatctttgcactgtacgtctcctactgatggcgcgagggaggc

SEQ ID NO: 5943 - DNA, 495 bp, Artificial Sequence
  source: /note="Description of Artificial Sequence: Synthetic polynucleotide"
gccttgccagcccgctcaggatgatccgtctcctattgcaggctctgaggcctcctatgagctgacacagccaccctcggtgtcagtgtccctaggacagatggccaggatcacctgctctggagaagcattgccaaaaaaatatgcttattggtaccagcagaagccaggccagttccctgtgctggtgatatataaagacagcgagaggccctcagggatccctgagcgattctctggctccagctcagggacaatagtcacattgaccatcagtggagtccaggcagaagacgaggctgactattactgtctatcagcagacagcagtggtatgagatgatccgtctcctagtcgactatttggtggaggaacccagctgatcattttagatgagtctcttcttccctttctttccctgccaagttggtgacaattttattctgatttcgatctttggatgatccgtctcctactgatggcgcgagggaggc

SEQ ID NO: 5944 - DNA, 495 bp, Artificial Sequence
  source: /note="Description of Artificial Sequence: Synthetic polynucleotide"
gccttgccagcccgctcagcgccaatagtctcctattgcaggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtggtatgacgccaatagtctcctagtcgactatttggtggaggaacccagctgatcattttagatgagtctcttcttccctttctttccctgccaagttggtgacaattttattctgatttcgatctttgcgccaatagtctcctactgatggcgcgagggaggc

SEQ ID NO: 5945 - DNA, 495 bp, Artificial Sequence
  source: /note="Description of Artificial Sequence: Synthetic polynucleotide"
gccttgccagcccgctcagtcaagcctgtctcctattgcaggctctgtgacctcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggacagtagtagtgtgatcaagcctgtctcctagtcgactatttggtggaggaacccagctgatcattttagatgagtctcttcttccctttctttccctgccaagttggtgacaattttattctgatttcgatctttgtcaagcctgtctcctactgatggcgcgagggaggc

SEQ ID NO: 5946 - DNA, 495 bp, Artificial Sequence
  source: /note="Description of Artificial Sequence: Synthetic polynucleotide"
gccttgccagcccgctcagacgtgtgtgtctcctacctctcttgcaggctctgttgcctcctatgagctgacacagctaccctcggtgtcagtgtccccaggacagaaagccaggatcacctgctctggagatgtactggggaaaaattatgctgactggtaccagcagaagccaggccaggcccctgagttggtgatatacgaagatagtgagcggtaccctggaatccctgaacgattctctgggtccacctcagggaacacgaccaccctgaccatcagcagggtcctgaccgaagacgaggctgactattactgtttgtctgggaatgaggtgaacgtgtgtgtctcctagtcgactatttggtggaggaacccagctgatcattttagatgagtctcttcttccctttctttccctgccaagttggtgacaattttattctgatttcgatctttgacgtgtgtgtctcctactgatggcgcgagggaggc

SEQ ID NO: 5947 - DNA, 495 bp, Artificial Sequence
  source: /note="Description of Artificial Sequence: Synthetic polynucleotide"
gccttgccagcccgctcagtccgtctagtctcctattgcaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagatgaggctgactattactgtcaatcagcagacagcagtggtatgatccgtctagtctcctagtcgactatttggtggaggaacccagctgatcattttagatgagtctcttcttccctttctttccctgccaagttggtgacaattttattctgatttcgatctttgtccgtctagtctcctactgatggcgcgagggaggc

SEQ ID NO: 5948 - DNA, 495 bp, Artificial Sequence
  source: /note="Description of Artificial Sequence: Synthetic polynucleotide"
gccttgccagcccgctcagaagagctggtctcctacttttcttgcagtctctgtggcctcctatgagctgacacagccatcctcagtgtcagtgtctccgggacagacagccaggatcacctgctcaggagatgtactggcaaaaaaatatgctcggtggttccagcagaagccaggccaggcccctgtgctggtgatttataaagacagtgagcggccctcagggatccctgagcgattctccggctccagctcagggaccacagtcaccttgaccatcagcggggcccaggttgaggatgaggctgactattactgttactctgcggctgacatgaaagagctggtctcctagtcgactatttggtggaggaacccagctgatcattttagatgagtctcttcttccctttctttccctgccaagttggtgacaattttattctgatttcgatctttgaagagctggtctcctactgatggcgcgagggaggc

SEQ ID NO: 5949 - DNA, 495 bp, Artificial Sequence
  source: /note="Description of Artificial Sequence: Synthetic polynucleotide"
gccttgccagcccgctcagtatcgctcgtctcctatgctgactcagcccccgtctgcatctgccttgctgggagcctcgatcaagctcacctgcaccctaagcagtgagcacagcacctacaccatcgaatggtatcaacagagaccagggaggtccccccagtatataatgaaggttaagagtgatggcagccacagcaagggggacgggatccccgatcgcttcatgggctccagttctggggctgaccgctacctcaccttctccaacctccagtctgacgatgaggctgagtatcactgtggagagagccacacgattgatggccaagtcgtgatatcgctcgtctcctagtcgactatttggtggaggaacccagctgatcattttagatgagtctcttcttccctttctttccctgccaagttggtgacaattttattctgatttcgatctttgtatcgctcgtctcctactgatggcgcgagggaggc

SEQ ID NO: 5950 - DNA, 495 bp, Artificial Sequence
  source: /note="Description of Artificial Sequence: Synthetic polynucleotide"
gccttgccagcccgctcagtcagatgcgtctcctactctctcccagcctgtgctgactcaatcatcctctgcctctgcttccctgggatcctcggtcaagctcacctgcactctgagcagtgggcacagtagctacatcatcgcatggcatcagcagcagccagggaaggcccctcggtacttgatgaagcttgaaggtagtggaagctacaacaaggggagcggagttcctgatcgcttctcaggctccagctctggggctgaccgctacctcaccatctccaacctccagtttgaggatgaggctgattattactgtgagacctgggacagtatgatcagatgcgtctcctagtcgactatttggtggaggaacccagctgatcattttagatgagtctcttcttccctttctttccctgccaagttggtgacaattttattctgatttcgatctttgtcagatgcgtctcctactgatggcgcgagggaggc

SEQ ID NO: 5951 - DNA, 495 bp, Artificial Sequence
  source: /note="Description of Artificial Sequence: Synthetic polynucleotide"
gccttgccagcccgctcaggtgtagcagtctcctactctctcccagcttgtgctgactcaatcgccctctgcctctgcctccctgggagcctcggtcaagctcacctgcactctgagcagtgggcacagcagctacgccatcgcatggcatcagcagcagccagagaagggccctcggtacttgatgaagcttaacagtgatggcagccacagcaagggggacgggatccctgatcgcttctcaggctccagctctggggctgagcgctacctcaccatctccagcctccagtctgaggatgaggctgactattactgtcagacctggggcactgtgagtgtagcagtctcctagtcgactatttggtggaggaacccagctgatcattttagatgagtctcttcttccctttctttccctgccaagttggtgacaattttattctgatttcgatctttggtgtagcagtctcctactgatggcgcgagggaggc

SEQ ID NO: 5952 - DNA, 495 bp, Artificial Sequence
  source: /note="Description of Artificial Sequence: Synthetic polynucleotide"
gccttgccagcccgctcagtggcagttgtctcctatgtgctgactcagccaccttcctcctccgcatctcctggagaatccgccagactcacctgcaccttgcccagtgacatcaatgttggtagctacaacatatactggtaccagcagaagccagggagccctcccaggtatctcctgtactactactcagactcagataagggccagggctctggagtccccagccgcttctctggatccaaagatgcttcagccaatacagggattttactcatctccgggctccagtctgaggatgaggctgactattactgtatgatttggccaagcaatgatggcagttgtctcctagtcgactatttggtggaggaacccagctgatcattttagatgagtctcttcttccctttctttccctgccaagttggtgacaattttattctgatttcgatctttgtggcagttgtctcctactgatggcgcgagggaggc

SEQ ID NO: 5953 - DNA, 495 bp, Artificial Sequence
  source: /note="Description of Artificial Sequence: Synthetic polynucleotide"
gccttgccagcccgctcagcagtccaagtctcctatgtgctgactcagccaacctccctctcagcatctcctggagcatcagccagattcacctgcaccttgcgcagcggcatcaatgttggtacctacaggatatactggtaccagcagaatccagggagtcttccccggtatctcctgaggtacaaatcagactcagataagcagcagggctctggagtccccagccgcttctctggatccaaagatgcttcaaccaatgcaggccttttactcatctctgggctccagtctgaagatgaggctgactattactgtgccatttggtacagcagtgacagtccaagtctcctagtcgactatttggtggaggaacccagctgatcattttagatgagtctcttcttccctttctttccctgccaagttggtgacaattttattctgatttcgatctttgcagtccaagtctcctactgatggcgcgagggaggc

SEQ ID NO: 5954 - DNA, 495 bp, Artificial Sequence
  source: /note="Description of Artificial Sequence: Synthetic polynucleotide"
gccttgccagcccgctcagtacgtacggtctcctatgtgctgactcagccgtcttccctctctgcatctcctggagcatcagccagtctcacctgcaccttgcgcagtggcatcaatgttggtacctacaggatatactggtaccagcagaagccagggagtcctccccagtatctcctgaggtacaaatcagactcagataagcagcagggctctggagtccccagccgcttctctggatccaaagatgcttcggccaatgcagggattttactcatctctgggctccagtctgaggatgaggctgactattactgtatgatttggcacagcagtgatacgtacggtctcctagtcgactatttggtggaggaacccagctgatcattttagatgagtctcttcttccctttctttccctgccaagttggtgacaattttattctgatttcgatctttgtacgtacggtctcctactgatggcgcgagggaggc

SEQ ID NO: 5955 - DNA, 495 bp, Artificial Sequence
  source: /note="Description of Artificial Sequence: Synthetic polynucleotide"
gccttgccagcccgctcagagtaccgagtctcctatgactcagccatcttcccattctgcatcttctggagcatcagtcagactcacctgcatgctgagcagtggcttcagtgttggggacttctggataaggtggtaccaacaaaagccagggaaccctccccggtatctcctgtactaccactcagactccaataagggccaaggctctggagttcccagccgcttctctggatccaacgatgcatcagccaatgcagggattctgcgtatctctgggctccagcctgaggatgaggctgactattactgtggtacatggcacagcaactctatgaagtaccgagtctcctagtcgactatttggtggaggaacccagctgatcattttagatgagtctcttcttccctttctttccctgccaagttggtgacaattttattctgatttcgatctttgagtaccgagtctcctactgatggcgcgagggaggc

SEQ ID NO: 5956 - DNA, 495 bp, Artificial Sequence
  source: /note="Description of Artificial Sequence: Synthetic polynucleotide"
gccttgccagcccgctcagatccatgggtctcctaagggtccaattctcagactgtggtgactcaggagccctcactgactgtgtccccaggagggacagtcactctcacctgtgcttccagcactggagcagtcaccagtggttactatccaaactggttccagcagaaacctggacaagcacccagggcactgatttatagtacaagcaacaaacactcctggacccctgcccggttctcaggctccctccttgggggcaaagctgccctgacactgtcaggtgtgcagcctgaggacgaggctgagtattactgcctgctctactatggtggtgaatccatgggtctcctagtcgactatttggtggaggaacccagctgatcattttagatgagtctcttcttccctttctttccctgccaagttggtgacaattttattctgatttcgatctttgatccatgggtctcctactgatggcgcgagggaggc

SEQ ID NO: 5957 - DNA, 495 bp, Artificial Sequence
  source: /note="Description of Artificial Sequence: Synthetic polynucleotide"
gccttgccagcccgctcaggtagcagtgtctcctaagggtccaattcccaggctgtggtgactcaggagccctcactgactgtgtccccaggagggacagtcactctcacctgtggctccagcactggagctgtcaccagtggtcattatccctactggttccagcagaagcctggccaagcccccaggacactgatttatgatacaagcaacaaacactcctggacacctgcccggttctcaggctccctccttgggggcaaagctgccctgacccttttgggtgcgcagcctgaggatgaggctgagtattactgcttgctctcctatagtggtgagtagcagtgtctcctagtcgactatttggtggaggaacccagctgatcattttagatgagtctcttcttccctttctttccctgccaagttggtgacaattttattctgatttcgatctttggtagcagtgtctcctactgatggcgcgagggaggc

SEQ ID NO: 5958 - DNA, 495 bp, Artificial Sequence
  source: /note="Description of Artificial Sequence: Synthetic polynucleotide"
gccttgccagcccgctcagatcttcgtgtctcctagagtggattctcagactgtggtgacccaggagccatcgttctcagtgtcccctggagggacagtcacactcacttgtggcttgagctctggctcagtctctactagttactaccccagctggtaccagcagaccccaggccaggctccacgcacgctcatctacagcacaaacactcgctcttctggggtccctgattgcttctctggctccatccttgggaacaaagctgccctcaccatcacgggggcccaggcagatgatgaatctgattattactgtgtgctgtatatgggtagtgtgaatcttcgtgtctcctagtcgactatttggtggaggaacccagctgatcattttagatgagtctcttcttccctttctttccctgccaagttggtgacaattttattctgatttcgatctttgatcttcgtgtctcctactgatggcgcgagggaggc

SEQ ID NO: 5959 - DNA, 495 bp, Artificial Sequence
  source: /note="Description of Artificial Sequence: Synthetic polynucleotide"
gccttgccagcccgctcagtccacagtgtctcctatgactcagccaccttctgcatcagcctccctgggagcctcggtcacactcacctgcaccctgagcagcggctacagtaattataaagtggactggtaccagcagagaccagggaagggcccccggtttgtgatgcgagtgggcactggtgggattgtgggatccaagggggatggcatccctgatcgcttctcagtcttgggctcaggcctgaatcggtacctgaccatcaagaacatccaggaagaagatgagagtgactaccactgtggggcagaccatggcagtgggagcaacttcgtgatccacagtgtctcctagtcgactatttggtggaggaacccagctgatcattttagatgagtctcttcttccctttctttccctgccaagttggtgacaattttattctgatttcgatctttgtccacagtgtctcctactgatggcgcgagggaggc

SEQ ID NO: 5960 - DNA, 495 bp, Artificial Sequence
  source: /note="Description of Artificial Sequence: Synthetic polynucleotide"
gccttgccagcccgctcagatgacaccgtctcctatgtcagtggtccaggcagggctgactcagccaccctcggtctccaagggcttgagacagaccgccacactcacctgcactgggaacagcaacaatgttggcaaccaaggagcagcttggcctgagcagcaccagggccaccctcccaaactcctatcctacaggaataacaaccggccctcagggatctcagagagattatctgcatccaggtcaggaaacacagcctccctgaccattactggactccagcctgaggacgaggctgactattactgctcagcatgggacagcagcctcatgaatgacaccgtctcctagtcgactatttggtggaggaacccagctgatcattttagatgagtctcttcttccctttctttccctgccaagttggtgacaattttattctgatttcgatctttgatgacaccgtctcctactgatggcgcgagggaggc

SEQ ID NO: 5961 - DNA, 495 bp, Artificial Sequence
  source: /note="Description of Artificial Sequence: Synthetic polynucleotide"
gccttgccagcccgctcagcttcacgagtctcctacgtgctgactcagccgccctctctgtctgcatccccgggagcaacagccagactcccctgcaccctgagcagtgacctcagtgttggtggtaaaaacatgttctggtaccagcagaagccagggagctctcccaggttattcctgtatcactactcagactcagacaagcagctgggacctggggtccccagtcgagtctctggctccaaggagacctcaagtaacacagcgtttttgctcatctctgggctccagcctgaggacgaggccgattattactgccaggtgtacgaaagtagtgacttcacgagtctcctagtcgactatttggtggaggaacccagctgatcattttagatgagtctcttcttccctttctttccctgccaagttggtgacaattttattctgatttcgatctttgcttcacgagtctcctactgatggcgcgagggaggc

SEQ ID NO: 5962 - DNA, 495 bp, Artificial Sequence
  source: /note="Description of Artificial Sequence: Synthetic polynucleotide"
gccttgccagcccgctcagtaggagacagagtgtcggtcctgggcccagtctgtgctgactcagccaccctcggtgtctgaagcccccaggcagagggtcaccatctcctgttctggaagcagctccaacatcggaaataatgctgtaaactggtaccagcagctcccaggaaaggctcccaaactcctcatctattatgatgatctgctgccctcaggggtctctgaccgattctctggctccaagtctggcacctcagcctccctggccatcagtgggctccagtctgaggatgaggctgattattactgtgcagcatgggatgacagcctgatgataggagacagagtgtcgtcgactgtttggtgaggggacggagctgaccgtcctagatgagtcttttccccctccttccctggtctccccaaggtactgggaaattttctgctgcttttgttctaggagacagagtgtcctgatggcgcgagggaggc

SEQ ID NO: 5963 - DNA, 495 bp, Artificial Sequence
  source: /note="Description of Artificial Sequence: Synthetic polynucleotide"
gccttgccagcccgctcaggtgtctacagagtgtccctgggcccagtctgtcgtgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgatgagtgtctacagagtgtcgtcgactgtttggtgaggggacggagctgaccgtcctagatgagtcttttccccctccttccctggtctccccaaggtactgggaaattttctgctgcttttgttcgtgtctacagagtgtcctgatggcgcgagggaggc

SEQ ID NO: 5964 - DNA, 495 bp, Artificial Sequence
  source: /note="Description of Artificial Sequence: Synthetic polynucleotide"
gccttgccagcccgctcaggtacagtgagagtgtcggtcctgggcccagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgatgagtacagtgagagtgtcgtcgactgtttggtgaggggacggagctgaccgtcctagatgagtcttttccccctccttccctggtctccccaaggtactgggaaattttctgctgcttttgttcgtacagtgagagtgtcctgatggcgcgagggaggc

SEQ ID NO: 5965 - DNA, 495 bp, Artificial Sequence
  source: /note="Description of Artificial Sequence: Synthetic polynucleotide"
gccttgccagcccgctcagggatcatcagagtgtcggtcctgggcccagtctgtgctgactcagccaccctcagcgtctgggacccccgggcagagggtcaccatctcttgttctggaagcagctccaacatcggaagtaattatgtatactggtaccagcagctcccaggaacggcccccaaactcctcatctatagtaataatcagcggccctcaggggtccctgaccgattctctggctccaagtctggcacctcagcctccctggccatcagtgggctccggtccgaggatgaggctgattattactgtgcagcatgggatgacagcctgatgaggatcatcagagtgtcgtcgactgtttggtgaggggacggagctgaccgtcctagatgagtcttttccccctccttccctggtctccccaaggtactgggaaattttctgctgcttttgttcggatcatcagagtgtcctgatggcgcgagggaggc

SEQ ID NO: 5966 - DNA, 495 bp, Artificial Sequence
  source: /note="Description of Artificial Sequence: Synthetic polynucleotide"
gccttgccagcccgctcagtattggcgagagtgtccctgggcccagtctgtgctgacgcagccgccctcagtgtctggggccccagggcagagggtcaccatctcctgcactgggagcagctccaacattggggcgggttatgttgtacattggtaccagcagcttccaggaacagcccccaaactcctcatctatggtaacagcaatcggccctcaggggtccctgaccaattctctggctccaagtctggcacctcagcctccctggccatcactggactccagtctgaggatgaggctgattattactgcaaagcatgggataacagcctgatgatattggcgagagtgtcgtcgactgtttggtgaggggacggagctgaccgtcctagatgagtcttttccccctccttccctggtctccccaaggtactgggaaattttctgctgcttttgttctattggcgagagtgtcctgatggcgcgagggaggc

SEQ ID NO: 5967 - DNA, 495 bp, Artificial Sequence
  source: /note="Description of Artificial Sequence: Synthetic polynucleotide"
gccttgccagcccgctcagaggcttgaagagtgtcggtcctgggcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgatgaaggcttgaagagtgtcgtcgactgtttggtgaggggacggagctgaccgtcctagatgagtcttttccccctccttccctggtctccccaaggtactgggaaattttctgctgcttttgttcaggcttgaagagtgtcctgatggcgcgagggaggc

SEQ ID NO: 5968 - DNA, 495 bp, Artificial Sequence
  source: /note="Description of Artificial Sequence: Synthetic polynucleotide"
gccttgccagcccgctcagacacacgtagagtgtcgtcctgggcccagtctgccctgactcagcctccctccgcgtccaggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaatgaacacacgtagagtgtcgtcgactgtttggtgaggggacggagctgaccgtcctagatgagtcttttccccctccttccctggtctccccaaggtactgggaaattttctgctgcttttgttcacacacgtagagtgtcctgatggcgcgagggaggc

SEQ ID NO: 5969 - DNA, 495 bp, Artificial Sequence
  source: /note="Description of Artificial Sequence: Synthetic polynucleotide"
gccttgccagcccgctcagtagacggaagagtgtcatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctatgatagacggaagagtgtcgtcgactgtttggtgaggggacggagctgaccgtcctagatgagtcttttccccctccttccctggtctccccaaggtactgggaaattttctgctgcttttgttctagacggaagagtgtcctgatggcgcgagggaggc

SEQ ID NO: 5970 - DNA, 495 bp, Artificial Sequence
  source: /note="Description of Artificial Sequence: Synthetic polynucleotide"
gccttgccagcccgctcagcagctcttagagtgtcgtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgaccatctctgggctccaggctgaggacgaggctgattattactgcagctcatatacaagcagcagtgacagctcttagagtgtcgtcgactgtttggtgaggggacggagctgaccgtcctagatgagtcttttccccctccttccctggtctccccaaggtactgggaaattttctgctgcttttgttccagctcttagagtgtcctgatggcgcgagggaggc

SEQ ID NO: 5971 - DNA, 495 bp, Artificial Sequence
  source: /note="Description of Artificial Sequence: Synthetic polynucleotide"
gccttgccagcccgctcaggagcgataagagtgtcatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaggtcagtaatcggccctcaggggtccctgatcgcttctctgggtccaagtctggcaacacggcctccctgaccacctctgggctccaggctgaggacgaggctgattattactgcagctcatatacaagcagcagtgagagcgataagagtgtcgtcgactgtttggtgaggggacggagctgaccgtcctagatgagtcttttccccctccttccctggtctccccaaggtactgggaaattttctgctgcttttgttcgagcgataagagtgtcctgatggcgcgagggaggc

SEQ ID NO: 5972 - DNA, 495 bp, Artificial Sequence
  source: /note="Description of Artificial Sequence: Synthetic polynucleotide"
gccttgccagcccgctcaggcatctgaagagtgtcgtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagtgagcatctgaagagtgtcgtcgactgtttggtgaggggacggagctgaccgtcctagatgagtcttttccccctccttccctggtctccccaaggtactgggaaattttctgctgcttttgttcgcatctgaagagtgtcctgatggcgcgagggaggc

SEQ ID NO: 5973 - DNA, 495 bp, Artificial Sequence
  source: /note="Description of Artificial Sequence: Synthetic polynucleotide"
gccttgccagcccgctcagtgctacacagagtgtcgtcctgggcccagtctgccctgactcagcctccttttgtgtccggggctcctggacagtcggtcaccatctcctgcactggaaccagcagtgacgttggggattatgatcatgtcttctggtaccaaaagcgtctcagcactacctccagactcctgatttacaatgtcaatactcggccttcagggatctctgacctcttctcaggctccaagtctggcaacatggcttccctgaccatctctgggctcaagtccgaggttgaggctaattatcactgcagcttatattcaagtagttatgatgctacacagagtgtcgtcgactgtttggtgaggggacggagctgaccgtcctagatgagtcttttccccctccttccctggtctccccaaggtactgggaaattttctgctgcttttgttctgctacacagagtgtcctgatggcgcgagggaggc

SEQ ID NO: 5974 - DNA, 495 bp, Artificial Sequence
  source: /note="Description of Artificial Sequence: Synthetic polynucleotide"
gccttgccagcccgctcagaactgccaagagtgtcctctcctgtaggatccgtggcctcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagtgaaactgccaagagtgtcgtcgactgtttggtgaggggacggagctgaccgtcctagatgagtcttttccccctccttccctggtctccccaaggtactgggaaattttctgctgcttttgttcaactgccaagagtgtcctgatggcgcgagggaggc

SEQ ID NO: 5975 - DNA, 495 bp, Artificial Sequence
  source: /note="Description of Artificial Sequence: Synthetic polynucleotide"
gccttgccagcccgctcagttggactgagagtgtcttttcttgcaggttctgtggcctcctatgagctgactcagccactctcagtgtcagtggccctgggacaggcggccaggattacctgtgggggaaacaaccttggatataaaaatgtgcactggtaccagcagaagccaggccaggcccctgtgctggtcatctatagggataacaaccggccctctgggatccctgagcgattctctggctccaactcggggaacacggccaccctgaccatcagcagagcccaagccggggatgaggctgactattactgtcaggtgtgggacagcagtgattggactgagagtgtcgtcgactgtttggtgaggggacggagctgaccgtcctagatgagtcttttccccctccttccctggtctccccaaggtactgggaaattttctgctgcttttgttcttggactgagagtgtcctgatggcgcgagggaggc

SEQ ID NO: 5976 - DNA, 495 bp, Artificial Sequence
  source: /note="Description of Artificial Sequence: Synthetic polynucleotide"
gccttgccagcccgctcaggtagacacagagtgtcttgcagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctatgaggacagcaaacgaccctccgggatccctgagagattctctggctccagctcagggacaatggccaccttgactatcagtggggcccaggtggaggatgaagctgactactactgttactcaacagacagcagtggtatgagtagacacagagtgtcgtcgactgtttggtgaggggacggagctgaccgtcctagatgagtcttttccccctccttccctggtctccccaaggtactgggaaattttctgctgcttttgttcgtagacacagagtgtcctgatggcgcgagggaggc

SEQ ID NO: 5977 - DNA, 495 bp, Artificial Sequence
  source: /note="Description of Artificial Sequence: Synthetic polynucleotide"
gccttgccagcccgctcagcactgtacagagtgtcttgcaggctctgcgacctcctatgagctgactcagccacactcagtgtcagtggccacagcacagatggccaggatcacctgtgggggaaacaacattggaagtaaagctgtgcactggtaccagcaaaagccaggccaggaccctgtgctggtcatctatagcgatagcaaccggccctcagggatccctgagcgattctctggctccaacccagggaacaccgccaccctaaccatcagcaggatcgaggctggggatgaggctgactattactgtcaggtgtgggacagtagtagtgtgacactgtacagagtgtcgtcgactgtttggtgaggggacggagctgaccgtcctagatgagtcttttccccctccttccctggtctccccaaggtactgggaaattttctgctgcttttgttccactgtacagagtgtcctgatggcgcgagggaggc

SEQ ID NO: 5978 - DNA, 495 bp, Artificial Sequence
  source: /note="Description of Artificial Sequence: Synthetic polynucleotide"
gccttgccagcccgctcaggatgatccagagtgtcttgcaggctctgaggcctcctatgagctgacacagccaccctcggtgtcagtgtccctaggacagatggccaggatcacctgctctggagaagcattgccaaaaaaatatgcttattggtaccagcagaagccaggccagttccctgtgctggtgatatataaagacagcgagaggccctcagggatccctgagcgattctctggctccagctcagggacaatagtcacattgaccatcagtggagtccaggcagaagacgaggctgactattactgtctatcagcagacagcagtggtatgagatgatccagagtgtcgtcgactgtttggtgaggggacggagctgaccgtcctagatgagtcttttccccctccttccctggtctccccaaggtactgggaaattttctgctgcttttgttcgatgatccagagtgtcctgatggcgcgagggaggc

SEQ ID NO: 5979 - DNA, 495 bp, Artificial Sequence
  source: /note="Description of Artificial Sequence: Synthetic polynucleotide"
gccttgccagcccgctcagcgccaataagagtgtcttgcaggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtggtatgacgccaataagagtgtcgtcgactgtttggtgaggggacggagctgaccgtcctagatgagtcttttccccctccttccctggtctccccaaggtactgggaaattttctgctgcttttgttccgccaataagagtgtcctgatggcgcgagggaggc

SEQ ID NO: 5980 - DNA, 495 bp, Artificial Sequence
  source: /note="Description of Artificial Sequence: Synthetic polynucleotide"
gccttgccagcccgctcagtcaagcctagagtgtcttgcaggctctgtgacctcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggacagtagtagtgtgatcaagcctagagtgtcgtcgactgtttggtgaggggacggagctgaccgtcctagatgagtcttttccccctccttccctggtctccccaaggtactgggaaattttctgctgcttttgttctcaagcctagagtgtcctgatggcgcgagggaggc

SEQ ID NO: 5981 - DNA, 495 bp, Artificial Sequence
  source: /note="Description of Artificial Sequence: Synthetic polynucleotide"
gccttgccagcccgctcagacgtgtgtagagtgtccctctcttgcaggctctgttgcctcctatgagctgacacagctaccctcggtgtcagtgtccccaggacagaaagccaggatcacctgctctggagatgtactggggaaaaattatgctgactggtaccagcagaagccaggccaggcccctgagttggtgatatacgaagatagtgagcggtaccctggaatccctgaacgattctctgggtccacctcagggaacacgaccaccctgaccatcagcagggtcctgaccgaagacgaggctgactattactgtttgtctgggaatgaggtgaacgtgtgtagagtgtcgtcgactgtttggtgaggggacggagctgaccgtcctagatgagtcttttccccctccttccctggtctccccaaggtactgggaaattttctgctgcttttgttcacgtgtgtagagtgtcctgatggcgcgagggaggc

SEQ ID NO: 5982 - DNA, 495 bp, Artificial Sequence
  source: /note="Description of Artificial Sequence: Synthetic polynucleotide"
gccttgccagcccgctcagtccgtctaagagtgtcttgcaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagatgaggctgactattactgtcaatcagcagacagcagtggtatgatccgtctaagagtgtcgtcgactgtttggtgaggggacggagctgaccgtcctagatgagtcttttccccctccttccctggtctccccaaggtactgggaaattttctgctgcttttgttctccgtctaagagtgtcctgatggcgcgagggaggc

SEQ ID NO: 5983 - DNA, 495 bp, Artificial Sequence
  source: /note="Description of Artificial Sequence: Synthetic polynucleotide"
gccttgccagcccgctcagaagagctgagagtgtccttttcttgcagtctctgtggcctcctatgagctgacacagccatcctcagtgtcagtgtctccgggacagacagccaggatcacctgctcaggagatgtactggcaaaaaaatatgctcggtggttccagcagaagccaggccaggcccctgtgctggtgatttataaagacagtgagcggccctcagggatccctgagcgattctccggctccagctcagggaccacagtcaccttgaccatcagcggggcccaggttgaggatgaggctgactattactgttactctgcggctgacatgaaagagctgagagtgtcgtcgactgtttggtgaggggacggagctgaccgtcctagatgagtcttttccccctccttccctggtctccccaaggtactgggaaattttctgctgcttttgttcaagagctgagagtgtcctgatggcgcgagggaggc

SEQ ID NO: 5984 - DNA, 495 bp, Artificial Sequence
  source: /note="Description of Artificial Sequence: Synthetic polynucleotide"
gccttgccagcccgctcagtatcgctcagagtgtctgctgactcagcccccgtctgcatctgccttgctgggagcctcgatcaagctcacctgcaccctaagcagtgagcacagcacctacaccatcgaatggtatcaacagagaccagggaggtccccccagtatataatgaaggttaagagtgatggcagccacagcaagggggacgggatccccgatcgcttcatgggctccagttctggggctgaccgctacctcaccttctccaacctccagtctgacgatgaggctgagtatcactgtggagagagccacacgattgatggccaagtcgtgatatcgctcagagtgtcgtcgactgtttggtgaggggacggagctgaccgtcctagatgagtcttttccccctccttccctggtctccccaaggtactgggaaattttctgctgcttttgttctatcgctcagagtgtcctgatggcgcgagggaggc

SEQ ID NO: 5985 - DNA, 495 bp, Artificial Sequence
  source: /note="Description of Artificial Sequence: Synthetic polynucleotide"
gccttgccagcccgctcagtcagatgcagagtgtcctctctcccagcctgtgctgactcaatcatcctctgcctctgcttccctgggatcctcggtcaagctcacctgcactctgagcagtgggcacagtagctacatcatcgcatggcatcagcagcagccagggaaggcccctcggtacttgatgaagcttgaaggtagtggaagctacaacaaggggagcggagttcctgatcgcttctcaggctccagctctggggctgaccgctacctcaccatctccaacctccagtttgaggatgaggctgattattactgtgagacctgggacagtatgatcagatgcagagtgtcgtcgactgtttggtgaggggacggagctgaccgtcctagatgagtcttttccccctccttccctggtctccccaaggtactgggaaattttctgctgcttttgttctcagatgcagagtgtcctgatggcgcgagggaggc

SEQ ID NO: 5986 - DNA, 495 bp, Artificial Sequence
  source: /note="Description of Artificial Sequence: Synthetic polynucleotide"
gccttgccagcccgctcaggtgtagcaagagtgtcctctctcccagcttgtgctgactcaatcgccctctgcctctgcctccctgggagcctcggtcaagctcacctgcactctgagcagtgggcacagcagctacgccatcgcatggcatcagcagcagccagagaagggccctcggtacttgatgaagcttaacagtgatggcagccacagcaagggggacgggatccctgatcgcttctcaggctccagctctggggctgagcgctacctcaccatctccagcctccagtctgaggatgaggctgactattactgtcagacctggggcactgtgagtgtagcaagagtgtcgtcgactgtttggtgaggggacggagctgaccgtcctagatgagtcttttccccctccttccctggtctccccaaggtactgggaaattttctgctgcttttgttcgtgtagcaagagtgtcctgatggcgcgagggaggc

SEQ ID NO: 5987 - DNA, 495 bp, Artificial Sequence
  source: /note="Description of Artificial Sequence: Synthetic polynucleotide"
gccttgccagcccgctcagtggcagttagagtgtctgtgctgactcagccaccttcctcctccgcatctcctggagaatccgccagactcacctgcaccttgcccagtgacatcaatgttggtagctacaacatatactggtaccagcagaagccagggagccctcccaggtatctcctgtactactactcagactcagataagggccagggctctggagtccccagccgcttctctggatccaaagatgcttcagccaatacagggattttactcatctccgggctccagtctgaggatgaggctgactattactgtatgatttggccaagcaatgatggcagttagagtgtcgtcgactgtttggtgaggggacggagctgaccgtcctagatgagtcttttccccctccttccctggtctccccaaggtactgggaaattttctgctgcttttgttctggcagttagagtgtcctgatggcgcgagggaggc

SEQ ID NO: 5988 - DNA, 495 bp, Artificial Sequence
  source: /note="Description of Artificial Sequence: Synthetic polynucleotide"
gccttgccagcccgctcagcagtccaaagagtgtctgtgctgactcagccaacctccctctcagcatctcctggagcatcagccagattcacctgcaccttgcgcagcggcatcaatgttggtacctacaggatatactggtaccagcagaatccagggagtcttccccggtatctcctgaggtacaaatcagactcagataagcagcagggctctggagtccccagccgcttctctggatccaaagatgcttcaaccaatgcaggccttttactcatctctgggctccagtctgaagatgaggctgactattactgtgccatttggtacagcagtgacagtccaaagagtgtcgtcgactgtttggtgaggggacggagctgaccgtcctagatgagtcttttccccctccttccctggtctccccaaggtactgggaaattttctgctgcttttgttccagtccaaagagtgtcctgatggcgcgagggaggc

SEQ ID NO: 5989 - DNA, 495 bp, Artificial Sequence
  source: /note="Description of Artificial Sequence: Synthetic polynucleotide"
gccttgccagcccgctcagtacgtacgagagtgtctgtgctgactcagccgtcttccctctctgcatctcctggagcatcagccagtctcacctgcaccttgcgcagtggcatcaatgttggtacctacaggatatactggtaccagcagaagccagggagtcctccccagtatctcctgaggtacaaatcagactcagataagcagcagggctctggagtccccagccgcttctctggatccaaagatgcttcggccaatgcagggattttactcatctctgggctccagtctgaggatgaggctgactattactgtatgatttggcacagcagtgatacgtacgagagtgtcgtcgactgtttggtgaggggacggagctgaccgtcctagatgagtcttttccccctccttccctggtctccccaaggtactgggaaattttctgctgcttttgttctacgtacgagagtgtcctgatggcgcgagggaggc

SEQ ID NO: 5990 - DNA, 495 bp, Artificial Sequence
  source: /note="Description of Artificial Sequence: Synthetic polynucleotide"
gccttgccagcccgctcagagtaccgaagagtgtctgactcagccatcttcccattctgcatcttctggagcatcagtcagactcacctgcatgctgagcagtggcttcagtgttggggacttctggataaggtggtaccaacaaaagccagggaaccctccccggtatctcctgtactaccactcagactccaataagggccaaggctctggagttcccagccgcttctctggatccaacgatgcatcagccaatgcagggattctgcgtatctctgggctccagcctgaggatgaggctgactattactgtggtacatggcacagcaactctatgaagtaccgaagagtgtcgtcgactgtttggtgaggggacggagctgaccgtcctagatgagtcttttccccctccttccctggtctccccaaggtactgggaaattttctgctgcttttgttcagtaccgaagagtgtcctgatggcgcgagggaggc

SEQ ID NO: 5991 - DNA, 495 bp, Artificial Sequence
  source: /note="Description of Artificial Sequence: Synthetic polynucleotide"
gccttgccagcccgctcagatccatggagagtgtcagggtccaattctcagactgtggtgactcaggagccctcactgactgtgtccccaggagggacagtcactctcacctgtgcttccagcactggagcagtcaccagtggttactatccaaactggttccagcagaaacctggacaagcacccagggcactgatttatagtacaagcaacaaacactcctggacccctgcccggttctcaggctccctccttgggggcaaagctgccctgacactgtcaggtgtgcagcctgaggacgaggctgagtattactgcctgctctactatggtggtgaatccatggagagtgtcgtcgactgtttggtgaggggacggagctgaccgtcctagatgagtcttttccccctccttccctggtctccccaaggtactgggaaattttctgctgcttttgttcatccatggagagtgtcctgatggcgcgagggaggc

SEQ ID NO: 5992 - DNA, 495 bp, Artificial Sequence
  source: /note="Description of Artificial Sequence: Synthetic polynucleotide"
gccttgccagcccgctcaggtagcagtagagtgtcagggtccaattcccaggctgtggtgactcaggagccctcactgactgtgtccccaggagggacagtcactctcacctgtggctccagcactggagctgtcaccagtggtcattatccctactggttccagcagaagcctggccaagcccccaggacactgatttatgatacaagcaacaaacactcctggacacctgcccggttctcaggctccctccttgggggcaaagctgccctgacccttttgggtgcgcagcctgaggatgaggctgagtattactgcttgctctcctatagtggtgagtagcagtagagtgtcgtcgactgtttggtgaggggacggagctgaccgtcctagatgagtcttttccccctccttccctggtctccccaaggtactgggaaattttctgctgcttttgttcgtagcagtagagtgtcctgatggcgcgagggaggc

SEQ ID NO: 5993 - DNA, 495 bp, Artificial Sequence
  source: /note="Description of Artificial Sequence: Synthetic polynucleotide"
gccttgccagcccgctcagatcttcgtagagtgtcgagtggattctcagactgtggtgacccaggagccatcgttctcagtgtcccctggagggacagtcacactcacttgtggcttgagctctggctcagtctctactagttactaccccagctggtaccagcagaccccaggccaggctccacgcacgctcatctacagcacaaacactcgctcttctggggtccctgattgcttctctggctccatccttgggaacaaagctgccctcaccatcacgggggcccaggcagatgatgaatctgattattactgtgtgctgtatatgggtagtgtgaatcttcgtagagtgtcgtcgactgtttggtgaggggacggagctgaccgtcctagatgagtcttttccccctccttccctggtctccccaaggtactgggaaattttctgctgcttttgttcatcttcgtagagtgtcctgatggcgcgagggaggc

SEQ ID NO: 5994 - DNA, 495 bp, Artificial Sequence
  source: /note="Description of Artificial Sequence: Synthetic polynucleotide"
gccttgccagcccgctcagtccacagtagagtgtctgactcagccaccttctgcatcagcctccctgggagcctcggtcacactcacctgcaccctgagcagcggctacagtaattataaagtggactggtaccagcagagaccagggaagggcccccggtttgtgatgcgagtgggcactggtgggattgtgggatccaagggggatggcatccctgatcgcttctcagtcttgggctcaggcctgaatcggtacctgaccatcaagaacatccaggaagaagatgagagtgactaccactgtggggcagaccatggcagtgggagcaacttcgtgatccacagtagagtgtcgtcgactgtttggtgaggggacggagctgaccgtcctagatgagtcttttccccctccttccctggtctccccaaggtactgggaaattttctgctgcttttgttctccacagtagagtgtcctgatggcgcgagggaggc

SEQ ID NO: 5995 - DNA, 495 bp, Artificial Sequence
  source: /note="Description of Artificial Sequence: Synthetic polynucleotide"
gccttgccagcccgctcagatgacaccagagtgtctgtcagtggtccaggcagggctgactcagccaccctcggtctccaagggcttgagacagaccgccacactcacctgcactgggaacagcaacaatgttggcaaccaaggagcagcttggcctgagcagcaccagggccaccctcccaaactcctatcctacaggaataacaaccggccctcagggatctcagagagattatctgcatccaggtcaggaaacacagcctccctgaccattactggactccagcctgaggacgaggctgactattactgctcagcatgggacagcagcctcatgaatgacaccagagtgtcgtcgactgtttggtgaggggacggagctgaccgtcctagatgagtcttttccccctccttccctggtctccccaaggtactgggaaattttctgctgcttttgttcatgacaccagagtgtcctgatggcgcgagggaggc

SEQ ID NO: 5996 - DNA, 495 bp, Artificial Sequence
  source: /note="Description of Artificial Sequence: Synthetic polynucleotide"
gccttgccagcccgctcagcttcacgaagagtgtccgtgctgactcagccgccctctctgtctgcatccccgggagcaacagccagactcccctgcaccctgagcagtgacctcagtgttggtggtaaaaacatgttctggtaccagcagaagccagggagctctcccaggttattcctgtatcactactcagactcagacaagcagctgggacctggggtccccagtcgagtctctggctccaaggagacctcaagtaacacagcgtttttgctcatctctgggctccagcctgaggacgaggccgattattactgccaggtgtacgaaagtagtgacttcacgaagagtgtcgtcgactgtttggtgaggggacggagctgaccgtcctagatgagtcttttccccctccttccctggtctccccaaggtactgggaaattttctgctgcttttgttccttcacgaagagtgtcctgatggcgcgagggaggc

SEQ ID NO: 5997 - DNA, 495 bp, Artificial Sequence
  source: /note="Description of Artificial Sequence: Synthetic polynucleotide"
gccttgccagcccgctcagtaggagacgttccgaaggtcctgggcccagtctgtgctgactcagccaccctcggtgtctgaagcccccaggcagagggtcaccatctcctgttctggaagcagctccaacatcggaaataatgctgtaaactggtaccagcagctcccaggaaaggctcccaaactcctcatctattatgatgatctgctgccctcaggggtctctgaccgattctctggctccaagtctggcacctcagcctccctggccatcagtgggctccagtctgaggatgaggctgattattactgtgcagcatgggatgacagcctgatgataggagacgttccgaagtcgactgttcggcagtggcaccaaggtgaccgtcctcggtgagtccccttttctattcttttgggtctagggtgagatctggggagacttttctgtcctttctgttaggagacgttccgaactgatggcgcgagggaggc

SEQ ID NO: 5998 - DNA, 495 bp, Artificial Sequence
  source: /note="Description of Artificial Sequence: Synthetic polynucleotide"
gccttgccagcccgctcaggtgtctacgttccgaacctgggcccagtctgtcgtgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgatgagtgtctacgttccgaagtcgactgttcggcagtggcaccaaggtgaccgtcctcggtgagtccccttttctattcttttgggtctagggtgagatctggggagacttttctgtcctttctgtgtgtctacgttccgaactgatggcgcgagggaggc

SEQ ID NO: 5999 - DNA, 495 bp, Artificial Sequence
  source: /note="Description of Artificial Sequence: Synthetic polynucleotide"
gccttgccagcccgctcaggtacagtggttccgaaggtcctgggcccagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgatgagtacagtggttccgaagtcgactgttcggcagtggcaccaaggtgaccgtcctcggtgagtccccttttctattcttttgggtctagggtgagatctggggagacttttctgtcctttctgtgtacagtggttccgaactgatggcgcgagggaggc

SEQ ID NO: 6000 - DNA, 495 bp, Artificial Sequence
  source: /note="Description of Artificial Sequence: Synthetic polynucleotide"
gccttgccagcccgctcagggatcatcgttccgaaggtcctgggcccagtctgtgctgactcagccaccctcagcgtctgggacccccgggcagagggtcaccatctcttgttctggaagcagctccaacatcggaagtaattatgtatactggtaccagcagctcccaggaacggcccccaaactcctcatctatagtaataatcagcggccctcaggggtccctgaccgattctctggctccaagtctggcacctcagcctccctggccatcagtgggctccggtccgaggatgaggctgattattactgtgcagcatgggatgacagcctgatgaggatcatcgttccgaagtcgactgttcggcagtggcaccaaggtgaccgtcctcggtgagtccccttttctattcttttgggtctagggtgagatctggggagacttttctgtcctttctgtggatcatcgttccgaactgatggcgcgagggaggc

SEQ ID NO: 6001 - DNA, 495 bp, Artificial Sequence
  source: /note="Description of Artificial Sequence: Synthetic polynucleotide"
gccttgccagcccgctcagtattggcggttccgaacctgggcccagtctgtgctgacgcagccgccctcagtgtctggggccccagggcagagggtcaccatctcctgcactgggagcagctccaacattggggcgggttatgttgtacattggtaccagcagcttccaggaacagcccccaaactcctcatctatggtaacagcaatcggccctcaggggtccctgaccaattctctggctccaagtctggcacctcagcctccctggccatcactggactccagtctgaggatgaggctgattattactgcaaagcatgggataacagcctgatgatattggcggttccgaagtcgactgttcggcagtggcaccaaggtgaccgtcctcggtgagtccccttttctattcttttgggtctagggtgagatctggggagacttttctgtcctttctgttattggcggttccgaactgatggcgcgagggaggc

SEQ ID NO: 6002 - DNA, 495 bp, Artificial Sequence
  source: /note="Description of Artificial Sequence: Synthetic polynucleotide"
gccttgccagcccgctcagaggcttgagttccgaaggtcctgggcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgatgaaggcttgagttccgaagtcgactgttcggcagtggcaccaaggtgaccgtcctcggtgagtccccttttctattcttttgggtctagggtgagatctggggagacttttctgtcctttctgtaggcttgagttccgaactgatggcgcgagggaggc

SEQ ID NO: 6003 - DNA, 495 bp, Artificial Sequence
  source: /note="Description of Artificial Sequence: Synthetic polynucleotide"
gccttgccagcccgctcagacacacgtgttccgaagtcctgggcccagtctgccctgactcagcctccctccgcgtccaggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaatgaacacacgtgttccgaagtcgactgttcggcagtggcaccaaggtgaccgtcctcggtgagtccccttttctattcttttgggtctagggtgagatctggggagacttttctgtcctttctgtacacacgtgttccgaactgatggcgcgagggaggc

SEQ ID NO: 6004 - DNA, 495 bp, Artificial Sequence
  source: /note="Description of Artificial Sequence: Synthetic polynucleotide"
gccttgccagcccgctcagtagacggagttccgaaatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctatgatagacggagttccgaagtcgactgttcggcagtggcaccaaggtgaccgtcctcggtgagtccccttttctattcttttgggtctagggtgagatctggggagacttttctgtcctttctgttagacggagttccgaactgatggcgcgagggaggc

SEQ ID NO: 6005 - DNA, 495 bp, Artificial Sequence
  source: /note="Description of Artificial Sequence: Synthetic polynucleotide"
gccttgccagcccgctcagcagctcttgttccgaagtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgaccatctctgggctccaggctgaggacgaggctgattattactgcagctcatatacaagcagcagtgacagctcttgttccgaagtcgactgttcggcagtggcaccaaggtgaccgtcctcggtgagtccccttttctattcttttgggtctagggtgagatctggggagacttttctgtcctttctgtcagctcttgttccgaactgatggcgcgagggaggc

SEQ ID NO: 6006 - DNA, 495 bp, Artificial Sequence
  source: /note="Description of Artificial Sequence: Synthetic polynucleotide"
gccttgccagcccgctcaggagcgatagttccgaaatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaggtcagtaatcggccctcaggggtccctgatcgcttctctgggtccaagtctggcaacacggcctccctgaccacctctgggctccaggctgaggacgaggctgattattactgcagctcatatacaagcagcagtgagagcgatagttccgaagtcgactgttcggcagtggcaccaaggtgaccgtcctcggtgagtccccttttctattcttttgggtctagggtgagatctggggagacttttctgtcctttctgtgagcgatagttccgaactgatggcgcgagggaggc

SEQ ID NO: 6007 - DNA, 495 bp, Artificial Sequence
  source: /note="Description of Artificial Sequence: Synthetic polynucleotide"
gccttgccagcccgctcaggcatctgagttccgaagtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagtgagcatctgagttccgaagtcgactgttcggcagtggcaccaaggtgaccgtcctcggtgagtccccttttctattcttttgggtctagggtgagatctggggagacttttctgtcctttctgtgcatctgagttccgaactgatggcgcgagggaggc

SEQ ID NO: 6008 - DNA, 495 bp, Artificial Sequence
  source: /note="Description of Artificial Sequence: Synthetic polynucleotide"
gccttgccagcccgctcagtgctacacgttccgaagtcctgggcccagtctgccctgactcagcctccttttgtgtccggggctcctggacagtcggtcaccatctcctgcactggaaccagcagtgacgttggggattatgatcatgtcttctggtaccaaaagcgtctcagcactacctccagactcctgatttacaatgtcaatactcggccttcagggatctctgacctcttctcaggctccaagtctggcaacatggcttccctgaccatctctgggctcaagtccgaggttgaggctaattatcactgcagcttatattcaagtagttatgatgctacacgttccgaagtcgactgttcggcagtggcaccaaggtgaccgtcctcggtgagtccccttttctattcttttgggtctagggtgagatctggggagacttttctgtcctttctgttgctacacgttccgaactgatggcgcgagggaggc

SEQ ID NO: 6009 - DNA, 495 bp, Artificial Sequence
  source: /note="Description of Artificial Sequence: Synthetic polynucleotide"
gccttgccagcccgctcagaactgccagttccgaactctcctgtaggatccgtggcctcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagtgaaactgccagttccgaagtcgactgttcggcagtggcaccaaggtgaccgtcctcggtgagtccccttttctattcttttgggtctagggtgagatctggggagacttttctgtcctttctgtaactgccagttccgaactgatggcgcgagggaggc

SEQ ID NO: 6010 - DNA, 495 bp, Artificial Sequence
  source: /note="Description of Artificial Sequence: Synthetic polynucleotide"
gccttgccagcccgctcagttggactggttccgaattttcttgcaggttctgtggcctcctatgagctgactcagccactctcagtgtcagtggccctgggacaggcggccaggattacctgtgggggaaacaaccttggatataaaaatgtgcactggtaccagcagaagccaggccaggcccctgtgctggtcatctatagggataacaaccggccctctgggatccctgagcgattctctggctccaactcggggaacacggccaccctgaccatcagcagagcccaagccggggatgaggctgactattactgtcaggtgtgggacagcagtgattggactggttccgaagtcgactgttcggcagtggcaccaaggtgaccgtcctcggtgagtccccttttctattcttttgggtctagggtgagatctggggagacttttctgtcctttctgtttggactggttccgaactgatggcgcgagggaggc

SEQ ID NO: 6011 - DNA, 495 bp, Artificial Sequence
  source: /note="Description of Artificial Sequence: Synthetic polynucleotide"
gccttgccagcccgctcaggtagacacgttccgaattgcagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctatgaggacagcaaacgaccctccgggatccctgagagattctctggctccagctcagggacaatggccaccttgactatcagtggggcccaggtggaggatgaagctgactactactgttactcaacagacagcagtggtatgagtagacacgttccgaagtcgactgttcggcagtggcaccaaggtgaccgtcctcggtgagtccccttttctattcttttgggtctagggtgagatctggggagacttttctgtcctttctgtgtagacacgttccgaactgatggcgcgagggaggc

SEQ ID NO: 6012 - DNA, 495 bp, Artificial Sequence
  source: /note="Description of Artificial Sequence: Synthetic polynucleotide"
gccttgccagcccgctcagcactgtacgttccgaattgcaggctctgcgacctcctatgagctgactcagccacactcagtgtcagtggccacagcacagatggccaggatcacctgtgggggaaacaacattggaagtaaagctgtgcactggtaccagcaaaagccaggccaggaccctgtgctggtcatctatagcgatagcaaccggccctcagggatccctgagcgattctctggctccaacccagggaacaccgccaccctaaccatcagcaggatcgaggctggggatgaggctgactattactgtcaggtgtgggacagtagtagtgtgacactgtacgttccgaagtcgactgttcggcagtggcaccaaggtgaccgtcctcggtgagtccccttttctattcttttgggtctagggtgagatctggggagacttttctgtcctttctgtcactgtacgttccgaactgatggcgcgagggaggc

SEQ ID NO: 6013 - DNA, 495 bp, Artificial Sequence
  source: /note="Description of Artificial Sequence: Synthetic polynucleotide"
gccttgccagcccgctcaggatgatccgttccgaattgcaggctctgaggcctcctatgagctgacacagccaccctcggtgtcagtgtccctaggacagatggccaggatcacctgctctggagaagcattgccaaaaaaatatgcttattggtaccagcagaagccaggccagttccctgtgctggtgatatataaagacagcgagaggccctcagggatccctgagcgattctctggctccagctcagggacaatagtcacattgaccatcagtggagtccaggcagaagacgaggctgactattactgtctatcagcagacagcagtggtatgagatgatccgttccgaagtcgactgttcggcagtggcaccaaggtgaccgtcctcggtgagtccccttttctattcttttgggtctagggtgagatctggggagacttttctgtcctttctgtgatgatccgttccgaactgatggcgcgagggaggc

SEQ ID NO: 6014 - DNA, 495 bp, Artificial Sequence
  source: /note="Description of Artificial Sequence: Synthetic polynucleotide"
gccttgccagcccgctcagcgccaatagttccgaattgcaggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtggtatgacgccaatagttccgaagtcgactgttcggcagtggcaccaaggtgaccgtcctcggtgagtccccttttctattcttttgggtctagggtgagatctggggagacttttctgtcctttctgtcgccaatagttccgaactgatggcgcgagggaggc

SEQ ID NO: 6015 - DNA, 495 bp, Artificial Sequence
  source: /note="Description of Artificial Sequence: Synthetic polynucleotide"
gccttgccagcccgctcagtcaagcctgttccgaattgcaggctctgtgacctcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggacagtagtagtgtgatcaagcctgttccgaagtcgactgttcggcagtggcaccaaggtgaccgtcctcggtgagtccccttttctattcttttgggtctagggtgagatctggggagacttttctgtcctttctgttcaagcctgttccgaactgatggcgcgagggaggc

SEQ ID NO: 6016 - DNA, 495 bp, Artificial Sequence
  source: /note="Description of Artificial Sequence: Synthetic polynucleotide"
gccttgccagcccgctcagacgtgtgtgttccgaacctctcttgcaggctctgttgcctcctatgagctgacacagctaccctcggtgtcagtgtccccaggacagaaagccaggatcacctgctctggagatgtactggggaaaaattatgctgactggtaccagcagaagccaggccaggcccctgagttggtgatatacgaagatagtgagcggtaccctggaatccctgaacgattctctgggtccacctcagggaacacgaccaccctgaccatcagcagggtcctgaccgaagacgaggctgactattactgtttgtctgggaatgaggtgaacgtgtgtgttccgaagtcgactgttcggcagtggcaccaaggtgaccgtcctcggtgagtccccttttctattcttttgggtctagggtgagatctggggagacttttctgtcctttctgtacgtgtgtgttccgaactgatggcgcgagggaggc

SEQ ID NO: 6017 - DNA, 495 bp, Artificial Sequence
  source: /note="Description of Artificial Sequence: Synthetic polynucleotide"
gccttgccagcccgctcagtccgtctagttccgaattgcaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagatgaggctgactattactgtcaatcagcagacagcagtggtatgatccgtctagttccgaagtcgactgttcggcagtggcaccaaggtgaccgtcctcggtgagtccccttttctattcttttgggtctagggtgagatctggggagacttttctgtcctttctgttccgtctagttccgaactgatggcgcgagggaggc

SEQ ID NO: 6018 - DNA, 495 bp, Artificial Sequence
  source: /note="Description of Artificial Sequence: Synthetic polynucleotide"
gccttgccagcccgctcagaagagctggttccgaacttttcttgcagtctctgtggcctcctatgagctgacacagccatcctcagtgtcagtgtctccgggacagacagccaggatcacctgctcaggagatgtactggcaaaaaaatatgctcggtggttccagcagaagccaggccaggcccctgtgctggtgatttataaagacagtgagcggccctcagggatccctgagcgattctccggctccagctcagggaccacagtcaccttgaccatcagcggggcccaggttgaggatgaggctgactattactgttactctgcggctgacatgaaagagctggttccgaagtcgactgttcggcagtggcaccaaggtgaccgtcctcggtgagtccccttttctattcttttgggtctagggtgagatctggggagacttttctgtcctttctgtaagagctggttccgaactgatggcgcgagggaggc

SEQ ID NO: 6019 - DNA, 495 bp, Artificial Sequence
  source: /note="Description of Artificial Sequence: Synthetic polynucleotide"
gccttgccagcccgctcagtatcgctcgttccgaatgctgactcagcccccgtctgcatctgccttgctgggagcctcgatcaagctcacctgcaccctaagcagtgagcacagcacctacaccatcgaatggtatcaacagagaccagggaggtccccccagtatataatgaaggttaagagtgatggcagccacagcaagggggacgggatccccgatcgcttcatgggctccagttctggggctgaccgctacctcaccttctccaacctccagtctgacgatgaggctgagtatcactgtggagagagccacacgattgatggccaagtcgtgatatcgctcgttccgaagtcgactgttcggcagtggcaccaaggtgaccgtcctcggtgagtccccttttctattcttttgggtctagggtgagatctggggagacttttctgtcctttctgttatcgctcgttccgaactgatggcgcgagggaggc

SEQ ID NO: 6020 - DNA, 495 bp, Artificial Sequence
  source: /note="Description of Artificial Sequence: Synthetic polynucleotide"
gccttgccagcccgctcagtcagatgcgttccgaactctctcccagcctgtgctgactcaatcatcctctgcctctgcttccctgggatcctcggtcaagctcacctgcactctgagcagtgggcacagtagctacatcatcgcatggcatcagcagcagccagggaaggcccctcggtacttgatgaagcttgaaggtagtggaagctacaacaaggggagcggagttcctgatcgcttctcaggctccagctctggggctgaccgctacctcaccatctccaacctccagtttgaggatgaggctgattattactgtgagacctgggacagtatgatcagatgcgttccgaagtcgactgttcggcagtggcaccaaggtgaccgtcctcggtgagtccccttttctattcttttgggtctagggtgagatctggggagacttttctgtcctttctgttcagatgcgttccgaactgatggcgcgagggaggc

SEQ ID NO: 6021 - DNA, 495 bp, Artificial Sequence
  source: /note="Description of Artificial Sequence: Synthetic polynucleotide"
gccttgccagcccgctcaggtgtagcagttccgaactctctcccagcttgtgctgactcaatcgccctctgcctctgcctccctgggagcctcggtcaagctcacctgcactctgagcagtgggcacagcagctacgccatcgcatggcatcagcagcagccagagaagggccctcggtacttgatgaagcttaacagtgatggcagccacagcaagggggacgggatccctgatcgcttctcaggctccagctctggggctgagcgctacctcaccatctccagcctccagtctgaggatgaggctgactattactgtcagacctggggcactgtgagtgtagcagttccgaagtcgactgttcggcagtggcaccaaggtgaccgtcctcggtgagtccccttttctattcttttgggtctagggtgagatctggggagacttttctgtcctttctgtgtgtagcagttccgaactgatggcgcgagggaggc

SEQ ID NO: 6022 - DNA, 495 bp, Artificial Sequence
  source: /note="Description of Artificial Sequence: Synthetic polynucleotide"
gccttgccagcccgctcagtggcagttgttccgaatgtgctgactcagccaccttcctcctccgcatctcctggagaatccgccagactcacctgcaccttgcccagtgacatcaatgttggtagctacaacatatactggtaccagcagaagccagggagccctcccaggtatctcctgtactactactcagactcagataagggccagggctctggagtccccagccgcttctctggatccaaagatgcttcagccaatacagggattttactcatctccgggctccagtctgaggatgaggctgactattactgtatgatttggccaagcaatgatggcagttgttccgaagtcgactgttcggcagtggcaccaaggtgaccgtcctcggtgagtccccttttctattcttttgggtctagggtgagatctggggagacttttctgtcctttctgttggcagttgttccgaactgatggcgcgagggaggc

SEQ ID NO: 6023 - DNA, 495 bp, Artificial Sequence
  source: /note="Description of Artificial Sequence: Synthetic polynucleotide"
gccttgccagcccgctcagcagtccaagttccgaatgtgctgactcagccaacctccctctcagcatctcctggagcatcagccagattcacctgcaccttgcgcagcggcatcaatgttggtacctacaggatatactggtaccagcagaatccagggagtcttccccggtatctcctgaggtacaaatcagactcagataagcagcagggctctggagtccccagccgcttctctggatccaaagatgcttcaaccaatgcaggccttttactcatctctgggctccagtctgaagatgaggctgactattactgtgccatttggtacagcagtgacagtccaagttccgaagtcgactgttcggcagtggcaccaaggtgaccgtcctcggtgagtccccttttctattcttttgggtctagggtgagatctggggagacttttctgtcctttctgtcagtccaagttccgaactgatggcgcgagggaggc

SEQ ID NO: 6024 - DNA, 495 bp, Artificial Sequence
  source: /note="Description of Artificial Sequence: Synthetic polynucleotide"
gccttgccagcccgctcagtacgtacggttccgaatgtgctgactcagccgtcttccctctctgcatctcctggagcatcagccagtctcacctgcaccttgcgcagtggcatcaatgttggtacctacaggatatactggtaccagcagaagccagggagtcctccccagtatctcctgaggtacaaatcagactcagataagcagcagggctctggagtccccagccgcttctctggatccaaagatgcttcggccaatgcagggattttactcatctctgggctccagtctgaggatgaggctgactattactgtatgatttggcacagcagtgatacgtacggttccgaagtcgactgttcggcagtggcaccaaggtgaccgtcctcggtgagtccccttttctattcttttgggtctagggtgagatctggggagacttttctgtcctttctgttacgtacggttccgaactgatggcgcgagggaggc

SEQ ID NO: 6025 - DNA, 495 bp, Artificial Sequence
  source: /note="Description of Artificial Sequence: Synthetic polynucleotide"
gccttgccagcccgctcagagtaccgagttccgaatgactcagccatcttcccattctgcatcttctggagcatcagtcagactcacctgcatgctgagcagtggcttcagtgttggggacttctggataaggtggtaccaacaaaagccagggaaccctccccggtatctcctgtactaccactcagactccaataagggccaaggctctggagttcccagccgcttctctggatccaacgatgcatcagccaatgcagggattctgcgtatctctgggctccagcctgaggatgaggctgactattactgtggtacatggcacagcaactctatgaagtaccgagttccgaagtcgactgttcggcagtggcaccaaggtgaccgtcctcggtgagtccccttttctattcttttgggtctagggtgagatctggggagacttttctgtcctttctgtagtaccgagttccgaactgatggcgcgagggaggc

SEQ ID NO: 6026 - DNA, 495 bp, Artificial Sequence
  source: /note="Description of Artificial Sequence: Synthetic polynucleotide"
gccttgccagcccgctcagatccatgggttccgaaagggtccaattctcagactgtggtgactcaggagccctcactgactgtgtccccaggagggacagtcactctcacctgtgcttccagcactggagcagtcaccagtggttactatccaaactggttccagcagaaacctggacaagcacccagggcactgatttatagtacaagcaacaaacactcctggacccctgcccggttctcaggctccctccttgggggcaaagctgccctgacactgtcaggtgtgcagcctgaggacgaggctgagtattactgcctgctctactatggtggtgaatccatgggttccgaagtcgactgttcggcagtggcaccaaggtgaccgtcctcggtgagtccccttttctattcttttgggtctagggtgagatctggggagacttttctgtcctttctgtatccatgggttccgaactgatggcgcgagggaggc

SEQ ID NO: 6027 - DNA, 495 bp, Artificial Sequence
  source: /note="Description of Artificial Sequence: Synthetic polynucleotide"
gccttgccagcccgctcaggtagcagtgttccgaaagggtccaattcccaggctgtggtgactcaggagccctcactgactgtgtccccaggagggacagtcactctcacctgtggctccagcactggagctgtcaccagtggtcattatccctactggttccagcagaagcctggccaagcccccaggacactgatttatgatacaagcaacaaacactcctggacacctgcccggttctcaggctccctccttgggggcaaagctgccctgacccttttgggtgcgcagcctgaggatgaggctgagtattactgcttgctctcctatagtggtgagtagcagtgttccgaagtcgactgttcggcagtggcaccaaggtgaccgtcctcggtgagtccccttttctattcttttgggtctagggtgagatctggggagacttttctgtcctttctgtgtagcagtgttccgaactgatggcgcgagggaggc

SEQ ID NO: 6028 - DNA, 495 bp, Artificial Sequence
  source: /note="Description of Artificial Sequence: Synthetic polynucleotide"
gccttgccagcccgctcagatcttcgtgttccgaagagtggattctcagactgtggtgacccaggagccatcgttctcagtgtcccctggagggacagtcacactcacttgtggcttgagctctggctcagtctctactagttactaccccagctggtaccagcagaccccaggccaggctccacgcacgctcatctacagcacaaacactcgctcttctggggtccctgattgcttctctggctccatccttgggaacaaagctgccctcaccatcacgggggcccaggcagatgatgaatctgattattactgtgtgctgtatatgggtagtgtgaatcttcgtgttccgaagtcgactgttcggcagtggcaccaaggtgaccgtcctcggtgagtccccttttctattcttttgggtctagggtgagatctggggagacttttctgtcctttctgtatcttcgtgttccgaactgatggcgcgagggaggc

SEQ ID NO: 6029 - DNA, 495 bp, Artificial Sequence
  source: /note="Description of Artificial Sequence: Synthetic polynucleotide"
gccttgccagcccgctcagtccacagtgttccgaatgactcagccaccttctgcatcagcctccctgggagcctcggtcacactcacctgcaccctgagcagcggctacagtaattataaagtggactggtaccagcagagaccagggaagggcccccggtttgtgatgcgagtgggcactggtgggattgtgggatccaagggggatggcatccctgatcgcttctcagtcttgggctcaggcctgaatcggtacctgaccatcaagaacatccaggaagaagatgagagtgactaccactgtggggcagaccatggcagtgggagcaacttcgtgatccacagtgttccgaagtcgactgttcggcagtggcaccaaggtgaccgtcctcggtgagtccccttttctattcttttgggtctagggtgagatctggggagacttttctgtcctttctgttccacagtgttccgaactgatggcgcgagggaggc

SEQ ID NO: 6030 - DNA, 495 bp, Artificial Sequence
  source: /note="Description of Artificial Sequence: Synthetic polynucleotide"
gccttgccagcccgctcagatgacaccgttccgaatgtcagtggtccaggcagggctgactcagccaccctcggtctccaagggcttgagacagaccgccacactcacctgcactgggaacagcaacaatgttggcaaccaaggagcagcttggcctgagcagcaccagggccaccctcccaaactcctatcctacaggaataacaaccggccctcagggatctcagagagattatctgcatccaggtcaggaaacacagcctccctgaccattactggactccagcctgaggacgaggctgactattactgctcagcatgggacagcagcctcatgaatgacaccgttccgaagtcgactgttcggcagtggcaccaaggtgaccgtcctcggtgagtccccttttctattcttttgggtctagggtgagatctggggagacttttctgtcctttctgtatgacaccgttccgaactgatggcgcgagggaggc

SEQ ID NO: 6031 - DNA, 495 bp, Artificial Sequence
  source: /note="Description of Artificial Sequence: Synthetic polynucleotide"
gccttgccagcccgctcagcttcacgagttccgaacgtgctgactcagccgccctctctgtctgcatccccgggagcaacagccagactcccctgcaccctgagcagtgacctcagtgttggtggtaaaaacatgttctggtaccagcagaagccagggagctctcccaggttattcctgtatcactactcagactcagacaagcagctgggacctggggtccccagtcgagtctctggctccaaggagacctcaagtaacacagcgtttttgctcatctctgggctccagcctgaggacgaggccgattattactgccaggtgtacgaaagtagtgacttcacgagttccgaagtcgactgttcggcagtggcaccaaggtgaccgtcctcggtgagtccccttttctattcttttgggtctagggtgagatctggggagacttttctgtcctttctgtcttcacgagttccgaactgatggcgcgagggaggc

SEQ ID NO: 6032 - DNA, 495 bp, Artificial Sequence
  source: /note="Description of Artificial Sequence: Synthetic polynucleotide"
gccttgccagcccgctcagtaggagaccgttacttggtcctgggcccagtctgtgctgactcagccaccctcggtgtctgaagcccccaggcagagggtcaccatctcctgttctggaagcagctccaacatcggaaataatgctgtaaactggtaccagcagctcccaggaaaggctcccaaactcctcatctattatgatgatctgctgccctcaggggtctctgaccgattctctggctccaagtctggcacctcagcctccctggccatcagtgggctccagtctgaggatgaggctgattattactgtgcagcatgggatgacagcctgatgataggagaccgttacttgtcgactgttcggaggaggcacccagctgaccgtcctcggtaagtctccccgcttctctcctctttgagatcccaagttaaacacggggagtttttccctttcctgtaggagaccgttacttctgatggcgcgagggaggc

SEQ ID NO: 6033 - DNA, 495 bp, Artificial Sequence
  source: /note="Description of Artificial Sequence: Synthetic polynucleotide"
gccttgccagcccgctcaggtgtctaccgttacttcctgggcccagtctgtcgtgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgatgagtgtctaccgttacttgtcgactgttcggaggaggcacccagctgaccgtcctcggtaagtctccccgcttctctcctctttgagatcccaagttaaacacggggagtttttccctttcctggtgtctaccgttacttctgatggcgcgagggaggc

SEQ ID NO: 6034 - DNA, 495 bp, Artificial Sequence
  source: /note="Description of Artificial Sequence: Synthetic polynucleotide"
gccttgccagcccgctcaggtacagtgcgttacttggtcctgggcccagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgatgagtacagtgcgttacttgtcgactgttcggaggaggcacccagctgaccgtcctcggtaagtctccccgcttctctcctctttgagatcccaagttaaacacggggagtttttccctttcctggtacagtgcgttacttctgatggcgcgagggaggc

SEQ ID NO: 6035 - DNA, 495 bp, Artificial Sequence
  source: /note="Description of Artificial Sequence: Synthetic polynucleotide"
gccttgccagcccgctcagggatcatccgttacttggtcctgggcccagtctgtgctgactcagccaccctcagcgtctgggacccccgggcagagggtcaccatctcttgttctggaagcagctccaacatcggaagtaattatgtatactggtaccagcagctcccaggaacggcccccaaactcctcatctatagtaataatcagcggccctcaggggtccctgaccgattctctggctccaagtctggcacctcagcctccctggccatcagtgggctccggtccgaggatgaggctgattattactgtgcagcatgggatgacagcctgatgaggatcatccgttacttgtcgactgttcggaggaggcacccagctgaccgtcctcggtaagtctccccgcttctctcctctttgagatcccaagttaaacacggggagtttttccctttcctgggatcatccgttacttctgatggcgcgagggaggc

SEQ ID NO: 6036 - DNA, 495 bp, Artificial Sequence
  source: /note="Description of Artificial Sequence: Synthetic polynucleotide"
gccttgccagcccgctcagtattggcgcgttacttcctgggcccagtctgtgctgacgcagccgccctcagtgtctggggccccagggcagagggtcaccatctcctgcactgggagcagctccaacattggggcgggttatgttgtacattggtaccagcagcttccaggaacagcccccaaactcctcatctatggtaacagcaatcggccctcaggggtccctgaccaattctctggctccaagtctggcacctcagcctccctggccatcactggactccagtctgaggatgaggctgattattactgcaaagcatgggataacagcctgatgatattggcgcgttacttgtcgactgttcggaggaggcacccagctgaccgtcctcggtaagtctccccgcttctctcctctttgagatcccaagttaaacacggggagtttttccctttcctgtattggcgcgttacttctgatggcgcgagggaggc

SEQ ID NO: 6037 - DNA, 495 bp, Artificial Sequence
  source: /note="Description of Artificial Sequence: Synthetic polynucleotide"
gccttgccagcccgctcagaggcttgacgttacttggtcctgggcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgatgaaggcttgacgttacttgtcgactgttcggaggaggcacccagctgaccgtcctcggtaagtctccccgcttctctcctctttgagatcccaagttaaacacggggagtttttccctttcctgaggcttgacgttacttctgatggcgcgagggaggc

SEQ ID NO: 6038 - DNA, 495 bp, Artificial Sequence
  source: /note="Description of Artificial Sequence: Synthetic polynucleotide"
gccttgccagcccgctcagacacacgtcgttacttgtcctgggcccagtctgccctgactcagcctccctccgcgtccaggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaatgaacacacgtcgttacttgtcgactgttcggaggaggcacccagctgaccgtcctcggtaagtctccccgcttctctcctctttgagatcccaagttaaacacggggagtttttccctttcctgacacacgtcgttacttctgatggcgcgagggaggc

SEQ ID NO: 6039 - DNA, 495 bp, Artificial Sequence
  source: /note="Description of Artificial Sequence: Synthetic polynucleotide"
gccttgccagcccgctcagtagacggacgttacttatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctatgatagacggacgttacttgtcgactgttcggaggaggcacccagctgaccgtcctcggtaagtctccccgcttctctcctctttgagatcccaagttaaacacggggagtttttccctttcctgtagacggacgttacttctgatggcgcgagggaggc

SEQ ID NO: 6040 - DNA, 495 bp, Artificial Sequence
  source: /note="Description of Artificial Sequence: Synthetic polynucleotide"
gccttgccagcccgctcagcagctcttcgttacttgtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgaccatctctgggctccaggctgaggacgaggctgattattactgcagctcatatacaagcagcagtgacagctcttcgttacttgtcgactgttcggaggaggcacccagctgaccgtcctcggtaagtctccccgcttctctcctctttgagatcccaagttaaacacggggagtttttccctttcctgcagctcttcgttacttctgatggcgcgagggaggc

SEQ ID NO: 6041 - DNA, 495 bp, Artificial Sequence
  source: /note="Description of Artificial Sequence: Synthetic polynucleotide"
gccttgccagcccgctcaggagcgatacgttacttatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaggtcagtaatcggccctcaggggtccctgatcgcttctctgggtccaagtctggcaacacggcctccctgaccacctctgggctccaggctgaggacgaggctgattattactgcagctcatatacaagcagcagtgagagcgatacgttacttgtcgactgttcggaggaggcacccagctgaccgtcctcggtaagtctccccgcttctctcctctttgagatcccaagttaaacacggggagtttttccctttcctggagcgatacgttacttctgatggcgcgagggaggc

SEQ ID NO: 6042 - DNA, 495 bp, Artificial Sequence
  source: /note="Description of Artificial Sequence: Synthetic polynucleotide"
gccttgccagcccgctcaggcatctgacgttacttgtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagtgagcatctgacgttacttgtcgactgttcggaggaggcacccagctgaccgtcctcggtaagtctccccgcttctctcctctttgagatcccaagttaaacacggggagtttttccctttcctggcatctgacgttacttctgatggcgcgagggaggc

SEQ ID NO: 6043 - DNA, 495 bp, Artificial Sequence
  source: /note="Description of Artificial Sequence: Synthetic polynucleotide"
gccttgccagcccgctcagtgctacaccgttacttgtcctgggcccagtctgccctgactcagcctccttttgtgtccggggctcctggacagtcggtcaccatctcctgcactggaaccagcagtgacgttggggattatgatcatgtcttctggtaccaaaagcgtctcagcactacctccagactcctgatttacaatgtcaatactcggccttcagggatctctgacctcttctcaggctccaagtctggcaacatggcttccctgaccatctctgggctcaagtccgaggttgaggctaattatcactgcagcttatattcaagtagttatgatgctacaccgttacttgtcgactgttcggaggaggcacccagctgaccgtcctcggtaagtctccccgcttctctcctctttgagatcccaagttaaacacggggagtttttccctttcctgtgctacaccgttacttctgatggcgcgagggaggc

SEQ ID NO: 6044 - DNA, 495 bp, Artificial Sequence
  source: /note="Description of Artificial Sequence: Synthetic polynucleotide"
gccttgccagcccgctcagaactgccacgttacttctctcctgtaggatccgtggcctcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagtgaaactgccacgttacttgtcgactgttcggaggaggcacccagctgaccgtcctcggtaagtctccccgcttctctcctctttgagatcccaagttaaacacggggagtttttccctttcctgaactgccacgttacttctgatggcgcgagggaggc

SEQ ID NO: 6045 - DNA, 495 bp, Artificial Sequence
  source: /note="Description of Artificial Sequence: Synthetic polynucleotide"
gccttgccagcccgctcagttggactgcgttacttttttcttgcaggttctgtggcctcctatgagctgactcagccactctcagtgtcagtggccctgggacaggcggccaggattacctgtgggggaaacaaccttggatataaaaatgtgcactggtaccagcagaagccaggccaggcccctgtgctggtcatctatagggataacaaccggccctctgggatccctgagcgattctctggctccaactcggggaacacggccaccctgaccatcagcagagcccaagccggggatgaggctgactattactgtcaggtgtgggacagcagtgattggactgcgttacttgtcgactgttcggaggaggcacccagctgaccgtcctcggtaagtctccccgcttctctcctctttgagatcccaagttaaacacggggagtttttccctttcctgttggactgcgttacttctgatggcgcgagggaggc

SEQ ID NO: 6046 - DNA, 495 bp, Artificial Sequence
  source: /note="Description of Artificial Sequence: Synthetic polynucleotide"
gccttgccagcccgctcaggtagacaccgttacttttgcagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctatgaggacagcaaacgaccctccgggatccctgagagattctctggctccagctcagggacaatggccaccttgactatcagtggggcccaggtggaggatgaagctgactactactgttactcaacagacagcagtggtatgagtagacaccgttacttgtcgactgttcggaggaggcacccagctgaccgtcctcggtaagtctccccgcttctctcctctttgagatcccaagttaaacacggggagtttttccctttcctggtagacaccgttacttctgatggcgcgagggaggc

SEQ ID NO: 6047 - DNA, 495 bp, Artificial Sequence
  source: /note="Description of Artificial Sequence: Synthetic polynucleotide"
gccttgccagcccgctcagcactgtaccgttacttttgcaggctctgcgacctcctatgagctgactcagccacactcagtgtcagtggccacagcacagatggccaggatcacctgtgggggaaacaacattggaagtaaagctgtgcactggtaccagcaaaagccaggccaggaccctgtgctggtcatctatagcgatagcaaccggccctcagggatccctgagcgattctctggctccaacccagggaacaccgccaccctaaccatcagcaggatcgaggctggggatgaggctgactattactgtcaggtgtgggacagtagtagtgtgacactgtaccgttacttgtcgactgttcggaggaggcacccagctgaccgtcctcggtaagtctccccgcttctctcctctttgagatcccaagttaaacacggggagtttttccctttcctgcactgtaccgttacttctgatggcgcgagggaggc

SEQ ID NO: 6048 - DNA, 495 bp, Artificial Sequence
  source: /note="Description of Artificial Sequence: Synthetic polynucleotide"
gccttgccagcccgctcaggatgatcccgttacttttgcaggctctgaggcctcctatgagctgacacagccaccctcggtgtcagtgtccctaggacagatggccaggatcacctgctctggagaagcattgccaaaaaaatatgcttattggtaccagcagaagccaggccagttccctgtgctggtgatatataaagacagcgagaggccctcagggatccctgagcgattctctggctccagctcagggacaatagtcacattgaccatcagtggagtccaggcagaagacgaggctgactattactgtctatcagcagacagcagtggtatgagatgatcccgttacttgtcgactgttcggaggaggcacccagctgaccgtcctcggtaagtctccccgcttctctcctctttgagatcccaagttaaacacggggagtttttccctttcctggatgatcccgttacttctgatggcgcgagggaggc

SEQ ID NO: 6049 - DNA, 495 bp, Artificial Sequence
  source: /note="Description of Artificial Sequence: Synthetic polynucleotide"
gccttgccagcccgctcagcgccaatacgttacttttgcaggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtggtatgacgccaatacgttacttgtcgactgttcggaggaggcacccagctgaccgtcctcggtaagtctccccgcttctctcctctttgagatcccaagttaaacacggggagtttttccctttcctgcgccaatacgttacttctgatggcgcgagggaggc

SEQ ID NO: 6050 - DNA, 495 bp, Artificial Sequence
  source: /note="Description of Artificial Sequence: Synthetic polynucleotide"
gccttgccagcccgctcagtcaagcctcgttacttttgcaggctctgtgacctcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggacagtagtagtgtgatcaagcctcgttacttgtcgactgttcggaggaggcacccagctgaccgtcctcggtaagtctccccgcttctctcctctttgagatcccaagttaaacacggggagtttttccctttcctgtcaagcctcgttacttctgatggcgcgagggaggc

SEQ ID NO: 6051 - DNA, 495 bp, Artificial Sequence
  source: /note="Description of Artificial Sequence: Synthetic polynucleotide"
gccttgccagcccgctcagacgtgtgtcgttacttcctctcttgcaggctctgttgcctcctatgagctgacacagctaccctcggtgtcagtgtccccaggacagaaagccaggatcacctgctctggagatgtactggggaaaaattatgctgactggtaccagcagaagccaggccaggcccctgagttggtgatatacgaagatagtgagcggtaccctggaatccctgaacgattctctgggtccacctcagggaacacgaccaccctgaccatcagcagggtcctgaccgaagacgaggctgactattactgtttgtctgggaatgaggtgaacgtgtgtcgttacttgtcgactgttcggaggaggcacccagctgaccgtcctcggtaagtctccccgcttctctcctctttgagatcccaagttaaacacggggagtttttccctttcctgacgtgtgtcgttacttctgatggcgcgagggaggc

SEQ ID NO: 6052 - DNA, 495 bp, Artificial Sequence
  source: /note="Description of Artificial Sequence: Synthetic polynucleotide"
gccttgccagcccgctcagtccgtctacgttacttttgcaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagatgaggctgactattactgtcaatcagcagacagcagtggtatgatccgtctacgttacttgtcgactgttcggaggaggcacccagctgaccgtcctcggtaagtctccccgcttctctcctctttgagatcccaagttaaacacggggagtttttccctttcctgtccgtctacgttacttctgatggcgcgagggaggc

SEQ ID NO: 6053 - DNA, 495 bp, Artificial Sequence
  source: /note="Description of Artificial Sequence: Synthetic polynucleotide"
gccttgccagcccgctcagaagagctgcgttacttcttttcttgcagtctctgtggcctcctatgagctgacacagccatcctcagtgtcagtgtctccgggacagacagccaggatcacctgctcaggagatgtactggcaaaaaaatatgctcggtggttccagcagaagccaggccaggcccctgtgctggtgatttataaagacagtgagcggccctcagggatccctgagcgattctccggctccagctcagggaccacagtcaccttgaccatcagcggggcccaggttgaggatgaggctgactattactgttactctgcggctgacatgaaagagctgcgttacttgtcgactgttcggaggaggcacccagctgaccgtcctcggtaagtctccccgcttctctcctctttgagatcccaagttaaacacggggagtttttccctttcctgaagagctgcgttacttctgatggcgcgagggaggc

SEQ ID NO: 6054 - DNA, 495 bp, Artificial Sequence
  source: /note="Description of Artificial Sequence: Synthetic polynucleotide"
gccttgccagcccgctcagtatcgctccgttactttgctgactcagcccccgtctgcatctgccttgctgggagcctcgatcaagctcacctgcaccctaagcagtgagcacagcacctacaccatcgaatggtatcaacagagaccagggaggtccccccagtatataatgaaggttaagagtgatggcagccacagcaagggggacgggatccccgatcgcttcatgggctccagttctggggctgaccgctacctcaccttctccaacctccagtctgacgatgaggctgagtatcactgtggagagagccacacgattgatggccaagtcgtgatatcgctccgttacttgtcgactgttcggaggaggcacccagctgaccgtcctcggtaagtctccccgcttctctcctctttgagatcccaagttaaacacggggagtttttccctttcctgtatcgctccgttacttctgatggcgcgagggaggc

SEQ ID NO: 6055 - DNA, 495 bp, Artificial Sequence
  source: /note="Description of Artificial Sequence: Synthetic polynucleotide"
gccttgccagcccgctcagtcagatgccgttacttctctctcccagcctgtgctgactcaatcatcctctgcctctgcttccctgggatcctcggtcaagctcacctgcactctgagcagtgggcacagtagctacatcatcgcatggcatcagcagcagccagggaaggcccctcggtacttgatgaagcttgaaggtagtggaagctacaacaaggggagcggagttcctgatcgcttctcaggctccagctctggggctgaccgctacctcaccatctccaacctccagtttgaggatgaggctgattattactgtgagacctgggacagtatgatcagatgccgttacttgtcgactgttcggaggaggcacccagctgaccgtcctcggtaagtctccccgcttctctcctctttgagatcccaagttaaacacggggagtttttccctttcctgtcagatgccgttacttctgatggcgcgagggaggc

SEQ ID NO: 6056 - DNA, 495 bp, Artificial Sequence
  source: /note="Description of Artificial Sequence: Synthetic polynucleotide"
gccttgccagcccgctcaggtgtagcacgttacttctctctcccagcttgtgctgactcaatcgccctctgcctctgcctccctgggagcctcggtcaagctcacctgcactctgagcagtgggcacagcagctacgccatcgcatggcatcagcagcagccagagaagggccctcggtacttgatgaagcttaacagtgatggcagccacagcaagggggacgggatccctgatcgcttctcaggctccagctctggggctgagcgctacctcaccatctccagcctccagtctgaggatgaggctgactattactgtcagacctggggcactgtgagtgtagcacgttacttgtcgactgttcggaggaggcacccagctgaccgtcctcggtaagtctccccgcttctctcctctttgagatcccaagttaaacacggggagtttttccctttcctggtgtagcacgttacttctgatggcgcgagggaggc

SEQ ID NO: 6057 - DNA, 495 bp, Artificial Sequence
  source: /note="Description of Artificial Sequence: Synthetic polynucleotide"
gccttgccagcccgctcagtggcagttcgttactttgtgctgactcagccaccttcctcctccgcatctcctggagaatccgccagactcacctgcaccttgcccagtgacatcaatgttggtagctacaacatatactggtaccagcagaagccagggagccctcccaggtatctcctgtactactactcagactcagataagggccagggctctggagtccccagccgcttctctggatccaaagatgcttcagccaatacagggattttactcatctccgggctccagtctgaggatgaggctgactattactgtatgatttggccaagcaatgatggcagttcgttacttgtcgactgttcggaggaggcacccagctgaccgtcctcggtaagtctccccgcttctctcctctttgagatcccaagttaaacacggggagtttttccctttcctgtggcagttcgttacttctgatggcgcgagggaggc

SEQ ID NO: 6058 - DNA, 495 bp, Artificial Sequence
  source: /note="Description of Artificial Sequence: Synthetic polynucleotide"
gccttgccagcccgctcagcagtccaacgttactttgtgctgactcagccaacctccctctcagcatctcctggagcatcagccagattcacctgcaccttgcgcagcggcatcaatgttggtacctacaggatatactggtaccagcagaatccagggagtcttccccggtatctcctgaggtacaaatcagactcagataagcagcagggctctggagtccccagccgcttctctggatccaaagatgcttcaaccaatgcaggccttttactcatctctgggctccagtctgaagatgaggctgactattactgtgccatttggtacagcagtgacagtccaacgttacttgtcgactgttcggaggaggcacccagctgaccgtcctcggtaagtctccccgcttctctcctctttgagatcccaagttaaacacggggagtttttccctttcctgcagtccaacgttacttctgatggcgcgagggaggc

SEQ ID NO: 6059 - DNA, 495 bp, Artificial Sequence
  source: /note="Description of Artificial Sequence: Synthetic polynucleotide"
gccttgccagcccgctcagtacgtacgcgttactttgtgctgactcagccgtcttccctctctgcatctcctggagcatcagccagtctcacctgcaccttgcgcagtggcatcaatgttggtacctacaggatatactggtaccagcagaagccagggagtcctccccagtatctcctgaggtacaaatcagactcagataagcagcagggctctggagtccccagccgcttctctggatccaaagatgcttcggccaatgcagggattttactcatctctgggctccagtctgaggatgaggctgactattactgtatgatttggcacagcagtgatacgtacgcgttacttgtcgactgttcggaggaggcacccagctgaccgtcctcggtaagtctccccgcttctctcctctttgagatcccaagttaaacacggggagtttttccctttcctgtacgtacgcgttacttctgatggcgcgagggaggc

SEQ ID NO: 6060 - DNA, 495 bp, Artificial Sequence
  source: /note="Description of Artificial Sequence: Synthetic polynucleotide"
gccttgccagcccgctcagagtaccgacgttactttgactcagccatcttcccattctgcatcttctggagcatcagtcagactcacctgcatgctgagcagtggcttcagtgttggggacttctggataaggtggtaccaacaaaagccagggaaccctccccggtatctcctgtactaccactcagactccaataagggccaaggctctggagttcccagccgcttctctggatccaacgatgcatcagccaatgcagggattctgcgtatctctgggctccagcctgaggatgaggctgactattactgtggtacatggcacagcaactctatgaagtaccgacgttacttgtcgactgttcggaggaggcacccagctgaccgtcctcggtaagtctccccgcttctctcctctttgagatcccaagttaaacacggggagtttttccctttcctgagtaccgacgttacttctgatggcgcgagggaggc

SEQ ID NO: 6061 - DNA, 495 bp, Artificial Sequence
  source: /note="Description of Artificial Sequence: Synthetic polynucleotide"
gccttgccagcccgctcagatccatggcgttacttagggtccaattctcagactgtggtgactcaggagccctcactgactgtgtccccaggagggacagtcactctcacctgtgcttccagcactggagcagtcaccagtggttactatccaaactggttccagcagaaacctggacaagcacccagggcactgatttatagtacaagcaacaaacactcctggacccctgcccggttctcaggctccctccttgggggcaaagctgccctgacactgtcaggtgtgcagcctgaggacgaggctgagtattactgcctgctctactatggtggtgaatccatggcgttacttgtcgactgttcggaggaggcacccagctgaccgtcctcggtaagtctccccgcttctctcctctttgagatcccaagttaaacacggggagtttttccctttcctgatccatggcgttacttctgatggcgcgagggaggc

SEQ ID NO: 6062 - DNA, 495 bp, Artificial Sequence
  source: /note="Description of Artificial Sequence: Synthetic polynucleotide"
gccttgccagcccgctcaggtagcagtcgttacttagggtccaattcccaggctgtggtgactcaggagccctcactgactgtgtccccaggagggacagtcactctcacctgtggctccagcactggagctgtcaccagtggtcattatccctactggttccagcagaagcctggccaagcccccaggacactgatttatgatacaagcaacaaacactcctggacacctgcccggttctcaggctccctccttgggggcaaagctgccctgacccttttgggtgcgcagcctgaggatgaggctgagtattactgcttgctctcctatagtggtgagtagcagtcgttacttgtcgactgttcggaggaggcacccagctgaccgtcctcggtaagtctccccgcttctctcctctttgagatcccaagttaaacacggggagtttttccctttcctggtagcagtcgttacttctgatggcgcgagggaggc

SEQ ID NO: 6063 - DNA, 495 bp, Artificial Sequence
  source: /note="Description of Artificial Sequence: Synthetic polynucleotide"
gccttgccagcccgctcagatcttcgtcgttacttgagtggattctcagactgtggtgacccaggagccatcgttctcagtgtcccctggagggacagtcacactcacttgtggcttgagctctggctcagtctctactagttactaccccagctggtaccagcagaccccaggccaggctccacgcacgctcatctacagcacaaacactcgctcttctggggtccctgattgcttctctggctccatccttgggaacaaagctgccctcaccatcacgggggcccaggcagatgatgaatctgattattactgtgtgctgtatatgggtagtgtgaatcttcgtcgttacttgtcgactgttcggaggaggcacccagctgaccgtcctcggtaagtctccccgcttctctcctctttgagatcccaagttaaacacggggagtttttccctttcctgatcttcgtcgttacttctgatggcgcgagggaggc

SEQ ID NO: 6064 - DNA, 495 bp, Artificial Sequence
  source: /note="Description of Artificial Sequence: Synthetic polynucleotide"
gccttgccagcccgctcagtccacagtcgttactttgactcagccaccttctgcatcagcctccctgggagcctcggtcacactcacctgcaccctgagcagcggctacagtaattataaagtggactggtaccagcagagaccagggaagggcccccggtttgtgatgcgagtgggcactggtgggattgtgggatccaagggggatggcatccctgatcgcttctcagtcttgggctcaggcctgaatcggtacctgaccatcaagaacatccaggaagaagatgagagtgactaccactgtggggcagaccatggcagtgggagcaacttcgtgatccacagtcgttacttgtcgactgttcggaggaggcacccagctgaccgtcctcggtaagtctccccgcttctctcctctttgagatcccaagttaaacacggggagtttttccctttcctgtccacagtcgttacttctgatggcgcgagggaggc

SEQ ID NO: 6065 - DNA, 495 bp, Artificial Sequence
  source: /note="Description of Artificial Sequence: Synthetic polynucleotide"
gccttgccagcccgctcagatgacacccgttactttgtcagtggtccaggcagggctgactcagccaccctcggtctccaagggcttgagacagaccgccacactcacctgcactgggaacagcaacaatgttggcaaccaaggagcagcttggcctgagcagcaccagggccaccctcccaaactcctatcctacaggaataacaaccggccctcagggatctcagagagattatctgcatccaggtcaggaaacacagcctccctgaccattactggactccagcctgaggacgaggctgactattactgctcagcatgggacagcagcctcatgaatgacacccgttacttgtcgactgttcggaggaggcacccagctgaccgtcctcggtaagtctccccgcttctctcctctttgagatcccaagttaaacacggggagtttttccctttcctgatgacacccgttacttctgatggcgcgagggaggc

SEQ ID NO: 6066 - DNA, 495 bp, Artificial Sequence
  source: /note="Description of Artificial Sequence: Synthetic polynucleotide"
gccttgccagcccgctcagcttcacgacgttacttcgtgctgactcagccgccctctctgtctgcatccccgggagcaacagccagactcccctgcaccctgagcagtgacctcagtgttggtggtaaaaacatgttctggtaccagcagaagccagggagctctcccaggttattcctgtatcactactcagactcagacaagcagctgggacctggggtccccagtcgagtctctggctccaaggagacctcaagtaacacagcgtttttgctcatctctgggctccagcctgaggacgaggccgattattactgccaggtgtacgaaagtagtgacttcacgacgttacttgtcgactgttcggaggaggcacccagctgaccgtcctcggtaagtctccccgcttctctcctctttgagatcccaagttaaacacggggagtttttccctttcctgcttcacgacgttacttctgatggcgcgagggaggc

SEQ ID NO: 6067 - DNA, 495 bp, Artificial Sequence
  source: /note="Description of Artificial Sequence: Synthetic polynucleotide"
gccttgccagcccgctcaggttccgaagacactctccaatctcaggtgccaaatgtgacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttgagttccgaagacactctgtcgaccgttcggccaagggaccaaggtggaaatcaaacgtgagtagaatttaaactttgcttcctcagttgtctgtgtcttctgttccctgtgtctatgaagtgagttccgaagacactctctgatggcgcgagggaggc

SEQ ID NO: 6068 - DNA, 495 bp, Artificial Sequence
  source: /note="Description of Artificial Sequence: Synthetic polynucleotide"
gccttgccagcccgctcagcgttacttgacactctccaatctcaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcctgatctatgctgcatccagtttacaaagtggggtcccatcaaggttcagcggcagtggatctggcacagatttcactctcaccatcagcagcctgcagcctgaagattttgcaacttattactgtctacaagattacaattgacgttacttgacactctgtcgaccgttcggccaagggaccaaggtggaaatcaaacgtgagtagaatttaaactttgcttcctcagttgtctgtgtcttctgttccctgtgtctatgaagtgacgttacttgacactctctgatggcgcgagggaggc

SEQ ID NO: 6069 - DNA, 495 bp, Artificial Sequence
  source: /note="Description of Artificial Sequence: Synthetic polynucleotide"
gccttgccagcccgctcagtaggagacgacactctccaatctcaggtgccagatgtgccatccggatgacccagtctccatcctcattctctgcatctacaggagacagagtcaccatcacttgtcgggcgagtcagggtattagcagttatttagcctggtatcagcaaaaaccagggaaagcccctaagctcctgatctatgctgcatccactttgcaaagtggggtcccatcaaggttcagcggcagtggatctgggacagatttcactctcaccatcagctgcctgcagtctgaagattttgcaacttattactgtcaacagtattatagttgataggagacgacactctgtcgaccgttcggccaagggaccaaggtggaaatcaaacgtgagtagaatttaaactttgcttcctcagttgtctgtgtcttctgttccctgtgtctatgaagtgataggagacgacactctctgatggcgcgagggaggc

SEQ ID NO: 6070 - DNA, 495 bp, Artificial Sequence
  source: /note="Description of Artificial Sequence: Synthetic polynucleotide"
gccttgccagcccgctcaggtgtctacgacactctccaatctcaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttgagtgtctacgacactctgtcgaccgttcggccaagggaccaaggtggaaatcaaacgtgagtagaatttaaactttgcttcctcagttgtctgtgtcttctgttccctgtgtctatgaagtgagtgtctacgacactctctgatggcgcgagggaggc

SEQ ID NO: 6071 - DNA, 495 bp, Artificial Sequence
  source: /note="Description of Artificial Sequence: Synthetic polynucleotide"
gccttgccagcccgctcaggtacagtggacactctccaatctcaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagttgagtacagtggacactctgtcgaccgttcggccaagggaccaaggtggaaatcaaacgtgagtagaatttaaactttgcttcctcagttgtctgtgtcttctgttccctgtgtctatgaagtgagtacagtggacactctctgatggcgcgagggaggc

SEQ ID NO: 6072 - DNA, 495 bp, Artificial Sequence
  source: /note="Description of Artificial Sequence: Synthetic polynucleotide"
gccttgccagcccgctcagggatcatcgacactctccaatctcaggtgccagatgtgccatccagttgacccagtctccatcctccctgtctgcatctgtaggagacagagtcaccatcacttgccgggcaagtcagggcattagcagtgctttagcctgatatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaataattgaggatcatcgacactctgtcgaccgttcggccaagggaccaaggtggaaatcaaacgtgagtagaatttaaactttgcttcctcagttgtctgtgtcttctgttccctgtgtctatgaagtgaggatcatcgacactctctgatggcgcgagggaggc

SEQ ID NO: 6073 - DNA, 495 bp, Artificial Sequence
  source: /note="Description of Artificial Sequence: Synthetic polynucleotide"
gccttgccagcccgctcagtattggcggacactctccaatctcaggtgccagatgtgacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcaacttattactgccaacagtataatagttgatattggcggacactctgtcgaccgttcggccaagggaccaaggtggaaatcaaacgtgagtagaatttaaactttgcttcctcagttgtctgtgtcttctgttccctgtgtctatgaagtgatattggcggacactctctgatggcgcgagggaggc

SEQ ID NO: 6074 - DNA, 495 bp, Artificial Sequence
  source: /note="Description of Artificial Sequence: Synthetic polynucleotide"
gccttgccagcccgctcagaggcttgagacactctccaatctcaggtgccaggtgtgacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttgaaggcttgagacactctgtcgaccgttcggccaagggaccaaggtggaaatcaaacgtgagtagaatttaaactttgcttcctcagttgtctgtgtcttctgttccctgtgtctatgaagtgaaggcttgagacactctctgatggcgcgagggaggc

SEQ ID NO: 6075 - DNA, 495 bp, Artificial Sequence
  source: /note="Description of Artificial Sequence: Synthetic polynucleotide"
gccttgccagcccgctcagacacacgtgacactctctaatatcagataccagatgtgacatccagatgacccagtctccatcctccctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgggacagatttcactctcaccatcagcagcctgcagcctgaagatgttgcaacttattactgtcaaaagtataacagttgaacacacgtgacactctgtcgaccgttcggccaagggaccaaggtggaaatcaaacgtgagtagaatttaaactttgcttcctcagttgtctgtgtcttctgttccctgtgtctatgaagtgaacacacgtgacactctctgatggcgcgagggaggc

SEQ ID NO: 6076 - DNA, 495 bp, Artificial Sequence
  source: /note="Description of Artificial Sequence: Synthetic polynucleotide"
gccttgccagcccgctcagtagacggagacactctctaatcgcaggtgccagatgtgacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataattgatagacggagacactctgtcgaccgttcggccaagggaccaaggtggaaatcaaacgtgagtagaatttaaactttgcttcctcagttgtctgtgtcttctgttccctgtgtctatgaagtgatagacggagacactctctgatggcgcgagggaggc

SEQ ID NO: 6077 - DNA, 495 bp, Artificial Sequence
  source: /note="Description of Artificial Sequence: Synthetic polynucleotide"
gccttgccagcccgctcagcagctcttgacactctccaatctcaggtgccagatgtgacatccagttgacccagtctccatcctccctgtctgcatctgtaggagacagagtcaccatcacttgccgggtgagtcagggcattagcagttatttaaattggtatcggcagaaaccagggaaagttcctaagctcctgatctatagtgcatccaatttgcaatctggagtcccatctcggttcagtggcagtggatctgggacagatttcactctcactatcagcagcctgcagcctgaagatgttgcaacttattacggtcaacggacttacaattgacagctcttgacactctgtcgaccgttcggccaagggaccaaggtggaaatcaaacgtgagtagaatttaaactttgcttcctcagttgtctgtgtcttctgttccctgtgtctatgaagtgacagctcttgacactctctgatggcgcgagggaggc

SEQ ID NO: 6078 - DNA, 495 bp, Artificial Sequence
  source: /note="Description of Artificial Sequence: Synthetic polynucleotide"
gccttgccagcccgctcaggagcgatagacactctccaatctcaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagttgagagcgatagacactctgtcgaccgttcggccaagggaccaaggtggaaatcaaacgtgagtagaatttaaactttgcttcctcagttgtctgtgtcttctgttccctgtgtctatgaagtgagagcgatagacactctctgatggcgcgagggaggc

SEQ ID NO: 6079 - DNA, 495 bp, Artificial Sequence
  source: /note="Description of Artificial Sequence: Synthetic polynucleotide"
gccttgccagcccgctcaggcatctgagacactctccaatctcaggtaccagatgtgacatccagatgacccagtctccatcctccctgtctgcatctgtaggagacagagtcaccatcacttgccgggcgagtcagggcattagcaattctttagcctggtatcagcagaaaccagggaaagcccctaagctcctgctctatgctgcatccagattggaaagtggggtcccatccaggttcagtggcagtggatctgggacggattacactctcaccatcagcagcctgcagcctgaagattttgcaacttattactgtcaacagtattatagttgagcatctgagacactctgtcgaccgttcggccaagggaccaaggtggaaatcaaacgtgagtagaatttaaactttgcttcctcagttgtctgtgtcttctgttccctgtgtctatgaagtgagcatctgagacactctctgatggcgcgagggaggc

SEQ ID NO: 6080 - DNA, 495 bp, Artificial Sequence
  source: /note="Description of Artificial Sequence: Synthetic polynucleotide"
gccttgccagcccgctcagtgctacacgacactctagtggggatattgtgatgacccagactccactctcctcacctgtcacccttggacagccggcctccatctcctgcaggtctagtcaaagcctcgtacacagtgatggaaacacctacttgagttggcttcagcagaggccaggccagcctccaagactcctaatttataagatttctaaccggttctctggggtcccagacagattcagtggcagtggggcagggacagatttcacactgaaaatcagcagggtggaagctgaggatgtcggggtttattactgcatgcaagctacacaatgatgctacacgacactctgtcgaccgttcggccaagggaccaaggtggaaatcaaacgtgagtagaatttaaactttgcttcctcagttgtctgtgtcttctgttccctgtgtctatgaagtgatgctacacgacactctctgatggcgcgagggaggc

SEQ ID NO: 6081 - DNA, 495 bp, Artificial Sequence
  source: /note="Description of Artificial Sequence: Synthetic polynucleotide"
gccttgccagcccgctcagaactgccagacactctagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaatgaaactgccagacactctgtcgaccgttcggccaagggaccaaggtggaaatcaaacgtgagtagaatttaaactttgcttcctcagttgtctgtgtcttctgttccctgtgtctatgaagtgaaactgccagacactctctgatggcgcgagggaggc

SEQ ID NO: 6082 - DNA, 495 bp, Artificial Sequence
  source: /note="Description of Artificial Sequence: Synthetic polynucleotide"
gccttgccagcccgctcagttggactggacactctagtgcggatattgtgatgacccagactccactctctctgtccgtcacccctggacagccggcctccatctcctgcaagtctagtcagagcctcctgcatagtgatggaaagacctatttgtattggtacctgcagaagccaggccagtctccacagctcctgatctatgaagtttccagccggttctctggagtgccagataggttcagtggcagcgggtcagggacagatttcacactgaaaatcagccgggtggaggctgaggatgttggggtttattactgaatgcaaggtatacactgattggactggacactctgtcgaccgttcggccaagggaccaaggtggaaatcaaacgtgagtagaatttaaactttgcttcctcagttgtctgtgtcttctgttccctgtgtctatgaagtgattggactggacactctctgatggcgcgagggaggc

SEQ ID NO: 6083 - DNA, 495 bp, Artificial Sequence
  source: /note="Description of Artificial Sequence: Synthetic polynucleotide"
gccttgccagcccgctcaggtagacacgacactctagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactgagtagacacgacactctgtcgaccgttcggccaagggaccaaggtggaaatcaaacgtgagtagaatttaaactttgcttcctcagttgtctgtgtcttctgttccctgtgtctatgaagtgagtagacacgacactctctgatggcgcgagggaggc

SEQ ID NO: 6084 - DNA, 495 bp, Artificial Sequence
  source: /note="Description of Artificial Sequence: Synthetic polynucleotide"
gccttgccagcccgctcagcactgtacgacactctgaggatattgtgatgacccagactccactctccctgcccgtcacccctggagagccggcctccatctcctgcaggtctagtcagagcctcttggatagtgatgatggaaacacctatttggactggtacctgcagaagccagggcagtctccacagctcctgatctatacgctttcctatcgggcctctggagtcccagacaggttcagtggcagtgggtcaggcactgatttcacactgaaaatcagcagggtggaggctgaggatgttggagtttattactgcatgcaacgtatagagtgacactgtacgacactctgtcgaccgttcggccaagggaccaaggtggaaatcaaacgtgagtagaatttaaactttgcttcctcagttgtctgtgtcttctgttccctgtgtctatgaagtgacactgtacgacactctctgatggcgcgagggaggc

SEQ ID NO: 6085 - DNA, 495 bp, Artificial Sequence
  source: /note="Description of Artificial Sequence: Synthetic polynucleotide"
gccttgccagcccgctcaggatgatccgacactctatctcagataccaccggagaaattgtaatgacacagtctccagccaccctgtctttgtctccaggggaaagagccaccctctcctgcagggccagtcagagtgttagcagcagctacttatcctggtaccagcagaaacctgggcaggctcccaggctcctcatctatggtgcatccaccagggccactggcatcccagccaggttcagtggcagtgggtctgggacagacttcactctcaccatcagcagcctgcagcctgaagattttgcagtttattactgtcagcaggattataactgagatgatccgacactctgtcgaccgttcggccaagggaccaaggtggaaatcaaacgtgagtagaatttaaactttgcttcctcagttgtctgtgtcttctgttccctgtgtctatgaagtgagatgatccgacactctctgatggcgcgagggaggc

SEQ ID NO: 6086 - DNA, 495 bp, Artificial Sequence
  source: /note="Description of Artificial Sequence: Synthetic polynucleotide"
gccttgccagcccgctcagcgccaatagacactctccaatttcagataccaccggagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactgacgccaatagacactctgtcgaccgttcggccaagggaccaaggtggaaatcaaacgtgagtagaatttaaactttgcttcctcagttgtctgtgtcttctgttccctgtgtctatgaagtgacgccaatagacactctctgatggcgcgagggaggc

SEQ ID NO: 6087 - DNA, 495 bp, Artificial Sequence
  source: /note="Description of Artificial Sequence: Synthetic polynucleotide"
gccttgccagcccgctcagtcaagcctgacactctccaatttcagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactgatcaagcctgacactctgtcgaccgttcggccaagggaccaaggtggaaatcaaacgtgagtagaatttaaactttgcttcctcagttgtctgtgtcttctgttccctgtgtctatgaagtgatcaagcctgacactctctgatggcgcgagggaggc

SEQ ID NO: 6088 - DNA, 495 bp, Artificial Sequence
  source: /note="Description of Artificial Sequence: Synthetic polynucleotide"
gccttgccagcccgctcagacgtgtgtgacactctatctcagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctgaacgtgtgtgacactctgtcgaccgttcggccaagggaccaaggtggaaatcaaacgtgagtagaatttaaactttgcttcctcagttgtctgtgtcttctgttccctgtgtctatgaagtgaacgtgtgtgacactctctgatggcgcgagggaggc

SEQ ID NO: 6089 - DNA, 495 bp, Artificial Sequence
  source: /note="Description of Artificial Sequence: Synthetic polynucleotide"
gccttgccagcccgctcagtccgtctagacactctccaatttcagataccaccggagaaattgtgttgacacagtctccagccaccctgtctttgtctccaggggaaagagccaccctctcctgcagggccagtcagggtgttagcagctacttagcctggtaccagcagaaacctggccaggctcccaggctcctcatctatgatgcatccaacagggccactggcatcccagccaggttcagtggcagtgggcctgggacagacttcactctcaccatcagcagcctagagcctgaagattttgcagtttattactgtcagcagcgtagcaactgatccgtctagacactctgtcgaccgttcggccaagggaccaaggtggaaatcaaacgtgagtagaatttaaactttgcttcctcagttgtctgtgtcttctgttccctgtgtctatgaagtgatccgtctagacactctctgatggcgcgagggaggc

SEQ ID NO: 6090 - DNA, 495 bp, Artificial Sequence
  source: /note="Description of Artificial Sequence: Synthetic polynucleotide"
gccttgccagcccgctcagaagagctggacactctggggacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagttgaaagagctggacactctgtcgaccgttcggccaagggaccaaggtggaaatcaaacgtgagtagaatttaaactttgcttcctcagttgtctgtgtcttctgttccctgtgtctatgaagtgaaagagctggacactctctgatggcgcgagggaggc

SEQ ID NO: 6091 - DNA, 495 bp, Artificial Sequence
  source: /note="Description of Artificial Sequence: Synthetic polynucleotide"
gccttgccagcccgctcagtatcgctcgacactctccataatcagataccagggcagaaacgacactcacgcagtctccagcattcatgtcagcgactccaggagacaaagtcaacatctcctgcaaagccagccaagacattgatgatgatatgaactggtaccaacagaaaccaggagaagctgctattttcattattcaagaagctactactctcgttcctggaatcccacctcgattcagtggcagcgggtatggaacagattttaccctcacaattaataacatagaatctgaggatgctgcatattacttctgtctacaacatgataattgatatcgctcgacactctgtcgaccgttcggccaagggaccaaggtggaaatcaaacgtgagtagaatttaaactttgcttcctcagttgtctgtgtcttctgttccctgtgtctatgaagtgatatcgctcgacactctctgatggcgcgagggaggc

SEQ ID NO: 6092 - DNA, 495 bp, Artificial Sequence
  source: /note="Description of Artificial Sequence: Synthetic polynucleotide"
gccttgccagcccgctcaggttccgaattcggaacccaatctcaggtgccaaatgtgacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttgagttccgaattcggaacgtcgacacttttggccaggggaccaagctggagatcaaacgtaagtacttttttccactgattcttcactgttgctaattagtttactttgtgttcctttgtgtgggttccgaattcggaacctgatggcgcgagggaggc

SEQ ID NO: 6093 - DNA, 495 bp, Artificial Sequence
  source: /note="Description of Artificial Sequence: Synthetic polynucleotide"
gccttgccagcccgctcagcgttacttttcggaacccaatctcaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcctgatctatgctgcatccagtttacaaagtggggtcccatcaaggttcagcggcagtggatctggcacagatttcactctcaccatcagcagcctgcagcctgaagattttgcaacttattactgtctacaagattacaattgacgttacttttcggaacgtcgacacttttggccaggggaccaagctggagatcaaacgtaagtacttttttccactgattcttcactgttgctaattagtttactttgtgttcctttgtgtggcgttacttttcggaacctgatggcgcgagggaggc

SEQ ID NO: 6094 - DNA, 495 bp, Artificial Sequence
  source: /note="Description of Artificial Sequence: Synthetic polynucleotide"
gccttgccagcccgctcagtaggagacttcggaacccaatctcaggtgccagatgtgccatccggatgacccagtctccatcctcattctctgcatctacaggagacagagtcaccatcacttgtcgggcgagtcagggtattagcagttatttagcctggtatcagcaaaaaccagggaaagcccctaagctcctgatctatgctgcatccactttgcaaagtggggtcccatcaaggttcagcggcagtggatctgggacagatttcactctcaccatcagctgcctgcagtctgaagattttgcaacttattactgtcaacagtattatagttgataggagacttcggaacgtcgacacttttggccaggggaccaagctggagatcaaacgtaagtacttttttccactgattcttcactgttgctaattagtttactttgtgttcctttgtgtggtaggagacttcggaacctgatggcgcgagggaggc

SEQ ID NO: 6095 - DNA, 495 bp, Artificial Sequence
  source: /note="Description of Artificial Sequence: Synthetic polynucleotide"
gccttgccagcccgctcaggtgtctacttcggaacccaatctcaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttgagtgtctacttcggaacgtcgacacttttggccaggggaccaagctggagatcaaacgtaagtacttttttccactgattcttcactgttgctaattagtttactttgtgttcctttgtgtgggtgtctacttcggaacctgatggcgcgagggaggc

SEQ ID NO: 6096 - DNA, 495 bp, Artificial Sequence
  source: /note="Description of Artificial Sequence: Synthetic polynucleotide"
gccttgccagcccgctcaggtacagtgttcggaacccaatctcaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagttgagtacagtgttcggaacgtcgacacttttggccaggggaccaagctggagatcaaacgtaagtacttttttccactgattcttcactgttgctaattagtttactttgtgttcctttgtgtgggtacagtgttcggaacctgatggcgcgagggaggc

SEQ ID NO: 6097 - DNA, 495 bp, Artificial Sequence
  source: /note="Description of Artificial Sequence: Synthetic polynucleotide"
gccttgccagcccgctcagggatcatcttcggaacccaatctcaggtgccagatgtgccatccagttgacccagtctccatcctccctgtctgcatctgtaggagacagagtcaccatcacttgccgggcaagtcagggcattagcagtgctttagcctgatatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaataattgaggatcatcttcggaacgtcgacacttttggccaggggaccaagctggagatcaaacgtaagtacttttttccactgattcttcactgttgctaattagtttactttgtgttcctttgtgtggggatcatcttcggaacctgatggcgcgagggaggc

SEQ ID NO: 6098 - DNA, 495 bp, Artificial Sequence
  source: /note="Description of Artificial Sequence: Synthetic polynucleotide"
gccttgccagcccgctcagtattggcgttcggaacccaatctcaggtgccagatgtgacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcaacttattactgccaacagtataatagttgatattggcgttcggaacgtcgacacttttggccaggggaccaagctggagatcaaacgtaagtacttttttccactgattcttcactgttgctaattagtttactttgtgttcctttgtgtggtattggcgttcggaacctgatggcgcgagggaggc

SEQ ID NO: 6099 - DNA, 495 bp, Artificial Sequence
  source: /note="Description of Artificial Sequence: Synthetic polynucleotide"
gccttgccagcccgctcagaggcttgattcggaacccaatctcaggtgccaggtgtgacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttgaaggcttgattcggaacgtcgacacttttggccaggggaccaagctggagatcaaacgtaagtacttttttccactgattcttcactgttgctaattagtttactttgtgttcctttgtgtggaggcttgattcggaacctgatggcgcgagggaggc

SEQ ID NO: 6100 - DNA, 495 bp, Artificial Sequence
  source: /note="Description of Artificial Sequence: Synthetic polynucleotide"
gccttgccagcccgctcagacacacgtttcggaacctaatatcagataccagatgtgacatccagatgacccagtctccatcctccctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgggacagatttcactctcaccatcagcagcctgcagcctgaagatgttgcaacttattactgtcaaaagtataacagttgaacacacgtttcggaacgtcgacacttttggccaggggaccaagctggagatcaaacgtaagtacttttttccactgattcttcactgttgctaattagtttactttgtgttcctttgtgtggacacacgtttcggaacctgatggcgcgagggaggc

SEQ ID NO: 6101 - DNA, 495 bp, Artificial Sequence
  source: /note="Description of Artificial Sequence: Synthetic polynucleotide"
gccttgccagcccgctcagtagacggattcggaacctaatcgcaggtgccagatgtgacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataattgatagacggattcggaacgtcgacacttttggccaggggaccaagctggagatcaaacgtaagtacttttttccactgattcttcactgttgctaattagtttactttgtgttcctttgtgtggtagacggattcggaacctgatggcgcgagggaggc

SEQ ID NO: 6102 - DNA, 495 bp, Artificial Sequence
  source: /note="Description of Artificial Sequence: Synthetic polynucleotide"
gccttgccagcccgctcagcagctcttttcggaacccaatctcaggtgccagatgtgacatccagttgacccagtctccatcctccctgtctgcatctgtaggagacagagtcaccatcacttgccgggtgagtcagggcattagcagttatttaaattggtatcggcagaaaccagggaaagttcctaagctcctgatctatagtgcatccaatttgcaatctggagtcccatctcggttcagtggcagtggatctgggacagatttcactctcactatcagcagcctgcagcctgaagatgttgcaacttattacggtcaacggacttacaattgacagctcttttcggaacgtcgacacttttggccaggggaccaagctggagatcaaacgtaagtacttttttccactgattcttcactgttgctaattagtttactttgtgttcctttgtgtggcagctcttttcggaacctgatggcgcgagggaggc

SEQ ID NO: 6103 - DNA, 495 bp, Artificial Sequence
  source: /note="Description of Artificial Sequence: Synthetic polynucleotide"
gccttgccagcccgctcaggagcgatattcggaacccaatctcaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagttgagagcgatattcggaacgtcgacacttttggccaggggaccaagctggagatcaaacgtaagtacttttttccactgattcttcactgttgctaattagtttactttgtgttcctttgtgtgggagcgatattcggaacctgatggcgcgagggaggc

SEQ ID NO: 6104 - DNA, 495 bp, Artificial Sequence
  source: /note="Description of Artificial Sequence: Synthetic polynucleotide"
gccttgccagcccgctcaggcatctgattcggaacccaatctcaggtaccagatgtgacatccagatgacccagtctccatcctccctgtctgcatctgtaggagacagagtcaccatcacttgccgggcgagtcagggcattagcaattctttagcctggtatcagcagaaaccagggaaagcccctaagctcctgctctatgctgcatccagattggaaagtggggtcccatccaggttcagtggcagtggatctgggacggattacactctcaccatcagcagcctgcagcctgaagattttgcaacttattactgtcaacagtattatagttgagcatctgattcggaacgtcgacacttttggccaggggaccaagctggagatcaaacgtaagtacttttttccactgattcttcactgttgctaattagtttactttgtgttcctttgtgtgggcatctgattcggaacctgatggcgcgagggaggc

SEQ ID NO: 6105 - DNA, 495 bp, Artificial Sequence
  source: /note="Description of Artificial Sequence: Synthetic polynucleotide"
gccttgccagcccgctcagtgctacacttcggaacagtggggatattgtgatgacccagactccactctcctcacctgtcacccttggacagccggcctccatctcctgcaggtctagtcaaagcctcgtacacagtgatggaaacacctacttgagttggcttcagcagaggccaggccagcctccaagactcctaatttataagatttctaaccggttctctggggtcccagacagattcagtggcagtggggcagggacagatttcacactgaaaatcagcagggtggaagctgaggatgtcggggtttattactgcatgcaagctacacaatgatgctacacttcggaacgtcgacacttttggccaggggaccaagctggagatcaaacgtaagtacttttttccactgattcttcactgttgctaattagtttactttgtgttcctttgtgtggtgctacacttcggaacctgatggcgcgagggaggc

SEQ ID NO: 6106 - DNA, 495 bp, Artificial Sequence
  source: /note="Description of Artificial Sequence: Synthetic polynucleotide"
gccttgccagcccgctcagaactgccattcggaacagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaatgaaactgccattcggaacgtcgacacttttggccaggggaccaagctggagatcaaacgtaagtacttttttccactgattcttcactgttgctaattagtttactttgtgttcctttgtgtggaactgccattcggaacctgatggcgcgagggaggc

SEQ ID NO: 6107 - DNA, 495 bp, Artificial Sequence
  source: /note="Description of Artificial Sequence: Synthetic polynucleotide"
gccttgccagcccgctcagttggactgttcggaacagtgcggatattgtgatgacccagactccactctctctgtccgtcacccctggacagccggcctccatctcctgcaagtctagtcagagcctcctgcatagtgatggaaagacctatttgtattggtacctgcagaagccaggccagtctccacagctcctgatctatgaagtttccagccggttctctggagtgccagataggttcagtggcagcgggtcagggacagatttcacactgaaaatcagccgggtggaggctgaggatgttggggtttattactgaatgcaaggtatacactgattggactgttcggaacgtcgacacttttggccaggggaccaagctggagatcaaacgtaagtacttttttccactgattcttcactgttgctaattagtttactttgtgttcctttgtgtggttggactgttcggaacctgatggcgcgagggaggc

SEQ ID NO: 6108 - DNA, 495 bp, Artificial Sequence
  source: /note="Description of Artificial Sequence: Synthetic polynucleotide"
gccttgccagcccgctcaggtagacacttcggaacagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactgagtagacacttcggaacgtcgacacttttggccaggggaccaagctggagatcaaacgtaagtacttttttccactgattcttcactgttgctaattagtttactttgtgttcctttgtgtgggtagacacttcggaacctgatggcgcgagggaggc

SEQ ID NO: 6109 - DNA, 495 bp, Artificial Sequence
  source: /note="Description of Artificial Sequence: Synthetic polynucleotide"
gccttgccagcccgctcagcactgtacttcggaacgaggatattgtgatgacccagactccactctccctgcccgtcacccctggagagccggcctccatctcctgcaggtctagtcagagcctcttggatagtgatgatggaaacacctatttggactggtacctgcagaagccagggcagtctccacagctcctgatctatacgctttcctatcgggcctctggagtcccagacaggttcagtggcagtgggtcaggcactgatttcacactgaaaatcagcagggtggaggctgaggatgttggagtttattactgcatgcaacgtatagagtgacactgtacttcggaacgtcgacacttttggccaggggaccaagctggagatcaaacgtaagtacttttttccactgattcttcactgttgctaattagtttactttgtgttcctttgtgtggcactgtacttcggaacctgatggcgcgagggaggc

SEQ ID NO: 6110 - DNA, 495 bp, Artificial Sequence
  source: /note="Description of Artificial Sequence: Synthetic polynucleotide"
gccttgccagcccgctcaggatgatccttcggaacatctcagataccaccggagaaattgtaatgacacagtctccagccaccctgtctttgtctccaggggaaagagccaccctctcctgcagggccagtcagagtgttagcagcagctacttatcctggtaccagcagaaacctgggcaggctcccaggctcctcatctatggtgcatccaccagggccactggcatcccagccaggttcagtggcagtgggtctgggacagacttcactctcaccatcagcagcctgcagcctgaagattttgcagtttattactgtcagcaggattataactgagatgatccttcggaacgtcgacacttttggccaggggaccaagctggagatcaaacgtaagtacttttttccactgattcttcactgttgctaattagtttactttgtgttcctttgtgtgggatgatccttcggaacctgatggcgcgagggaggc

SEQ ID NO: 6111 - DNA, 495 bp, Artificial Sequence
  source: /note="Description of Artificial Sequence: Synthetic polynucleotide"
gccttgccagcccgctcagcgccaatattcggaacccaatttcagataccaccggagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactgacgccaatattcggaacgtcgacacttttggccaggggaccaagctggagatcaaacgtaagtacttttttccactgattcttcactgttgctaattagtttactttgtgttcctttgtgtggcgccaatattcggaacctgatggcgcgagggaggc

SEQ ID NO: 6112 - DNA, 495 bp, Artificial Sequence
  source: /note="Description of Artificial Sequence: Synthetic polynucleotide"
gccttgccagcccgctcagtcaagcctttcggaacccaatttcagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactgatcaagcctttcggaacgtcgacacttttggccaggggaccaagctggagatcaaacgtaagtacttttttccactgattcttcactgttgctaattagtttactttgtgttcctttgtgtggtcaagcctttcggaacctgatggcgcgagggaggc

SEQ ID NO: 6113 - DNA, 495 bp, Artificial Sequence
  source: /note="Description of Artificial Sequence: Synthetic polynucleotide"
gccttgccagcccgctcagacgtgtgtttcggaacatctcagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctgaacgtgtgtttcggaacgtcgacacttttggccaggggaccaagctggagatcaaacgtaagtacttttttccactgattcttcactgttgctaattagtttactttgtgttcctttgtgtggacgtgtgtttcggaacctgatggcgcgagggaggc

SEQ ID NO: 6114 - DNA, 495 bp, Artificial Sequence
  source: /note="Description of Artificial Sequence: Synthetic polynucleotide"
gccttgccagcccgctcagtccgtctattcggaacccaatttcagataccaccggagaaattgtgttgacacagtctccagccaccctgtctttgtctccaggggaaagagccaccctctcctgcagggccagtcagggtgttagcagctacttagcctggtaccagcagaaacctggccaggctcccaggctcctcatctatgatgcatccaacagggccactggcatcccagccaggttcagtggcagtgggcctgggacagacttcactctcaccatcagcagcctagagcctgaagattttgcagtttattactgtcagcagcgtagcaactgatccgtctattcggaacgtcgacacttttggccaggggaccaagctggagatcaaacgtaagtacttttttccactgattcttcactgttgctaattagtttactttgtgttcctttgtgtggtccgtctattcggaacctgatggcgcgagggaggc

SEQ ID NO: 6115 - DNA, 495 bp, Artificial Sequence
  source: /note="Description of Artificial Sequence: Synthetic polynucleotide"
gccttgccagcccgctcagaagagctgttcggaacggggacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagttgaaagagctgttcggaacgtcgacacttttggccaggggaccaagctggagatcaaacgtaagtacttttttccactgattcttcactgttgctaattagtttactttgtgttcctttgtgtggaagagctgttcggaacctgatggcgcgagggaggc

SEQ ID NO: 6116 - DNA, 495 bp, Artificial Sequence
  source: /note="Description of Artificial Sequence: Synthetic polynucleotide"
gccttgccagcccgctcagtatcgctcttcggaacccataatcagataccagggcagaaacgacactcacgcagtctccagcattcatgtcagcgactccaggagacaaagtcaacatctcctgcaaagccagccaagacattgatgatgatatgaactggtaccaacagaaaccaggagaagctgctattttcattattcaagaagctactactctcgttcctggaatcccacctcgattcagtggcagcgggtatggaacagattttaccctcacaattaataacatagaatctgaggatgctgcatattacttctgtctacaacatgataattgatatcgctcttcggaacgtcgacacttttggccaggggaccaagctggagatcaaacgtaagtacttttttccactgattcttcactgttgctaattagtttactttgtgttcctttgtgtggtatcgctcttcggaacctgatggcgcgagggaggc

SEQ ID NO: 6117 - DNA, 495 bp, Artificial Sequence
  source: /note="Description of Artificial Sequence: Synthetic polynucleotide"
gccttgccagcccgctcaggttccgaaaagtaacgccaatctcaggtgccaaatgtgacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttgagttccgaaaagtaacggtcgacctttcggccctgggaccaaagtggatatcaaacgtaagtacatctgtctcaattattcgtgagattttagtgccattgtatcatttgtgcaagttttgtggttccgaaaagtaacgctgatggcgcgagggaggc

SEQ ID NO: 6118 - DNA, 495 bp, Artificial Sequence
  source: /note="Description of Artificial Sequence: Synthetic polynucleotide"
gccttgccagcccgctcagcgttacttaagtaacgccaatctcaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcctgatctatgctgcatccagtttacaaagtggggtcccatcaaggttcagcggcagtggatctggcacagatttcactctcaccatcagcagcctgcagcctgaagattttgcaacttattactgtctacaagattacaattgacgttacttaagtaacggtcgacctttcggccctgggaccaaagtggatatcaaacgtaagtacatctgtctcaattattcgtgagattttagtgccattgtatcatttgtgcaagttttgtgcgttacttaagtaacgctgatggcgcgagggaggc

SEQ ID NO: 6119 - DNA, 495 bp, Artificial Sequence
  source: /note="Description of Artificial Sequence: Synthetic polynucleotide"
gccttgccagcccgctcagtaggagacaagtaacgccaatctcaggtgccagatgtgccatccggatgacccagtctccatcctcattctctgcatctacaggagacagagtcaccatcacttgtcgggcgagtcagggtattagcagttatttagcctggtatcagcaaaaaccagggaaagcccctaagctcctgatctatgctgcatccactttgcaaagtggggtcccatcaaggttcagcggcagtggatctgggacagatttcactctcaccatcagctgcctgcagtctgaagattttgcaacttattactgtcaacagtattatagttgataggagacaagtaacggtcgacctttcggccctgggaccaaagtggatatcaaacgtaagtacatctgtctcaattattcgtgagattttagtgccattgtatcatttgtgcaagttttgtgtaggagacaagtaacgctgatggcgcgagggaggc

SEQ ID NO: 6120 - DNA, 495 bp, Artificial Sequence
  source: /note="Description of Artificial Sequence: Synthetic polynucleotide"
gccttgccagcccgctcaggtgtctacaagtaacgccaatctcaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttgagtgtctacaagtaacggtcgacctttcggccctgggaccaaagtggatatcaaacgtaagtacatctgtctcaattattcgtgagattttagtgccattgtatcatttgtgcaagttttgtggtgtctacaagtaacgctgatggcgcgagggaggc

SEQ ID NO: 6121 - DNA, 495 bp, Artificial Sequence
  source: /note="Description of Artificial Sequence: Synthetic polynucleotide"
gccttgccagcccgctcaggtacagtgaagtaacgccaatctcaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagttgagtacagtgaagtaacggtcgacctttcggccctgggaccaaagtggatatcaaacgtaagtacatctgtctcaattattcgtgagattttagtgccattgtatcatttgtgcaagttttgtggtacagtgaagtaacgctgatggcgcgagggaggc

SEQ ID NO: 6122 - DNA, 495 bp, Artificial Sequence
  source: /note="Description of Artificial Sequence: Synthetic polynucleotide"
gccttgccagcccgctcagggatcatcaagtaacgccaatctcaggtgccagatgtgccatccagttgacccagtctccatcctccctgtctgcatctgtaggagacagagtcaccatcacttgccgggcaagtcagggcattagcagtgctttagcctgatatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaataattgaggatcatcaagtaacggtcgacctttcggccctgggaccaaagtggatatcaaacgtaagtacatctgtctcaattattcgtgagattttagtgccattgtatcatttgtgcaagttttgtgggatcatcaagtaacgctgatggcgcgagggaggc

SEQ ID NO: 6123 - DNA, 495 bp, Artificial Sequence
  source: /note="Description of Artificial Sequence: Synthetic polynucleotide"
gccttgccagcccgctcagtattggcgaagtaacgccaatctcaggtgccagatgtgacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcaacttattactgccaacagtataatagttgatattggcgaagtaacggtcgacctttcggccctgggaccaaagtggatatcaaacgtaagtacatctgtctcaattattcgtgagattttagtgccattgtatcatttgtgcaagttttgtgtattggcgaagtaacgctgatggcgcgagggaggc

SEQ ID NO: 6124 - DNA, 495 bp, Artificial Sequence
  source: /note="Description of Artificial Sequence: Synthetic polynucleotide"
gccttgccagcccgctcagaggcttgaaagtaacgccaatctcaggtgccaggtgtgacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttgaaggcttgaaagtaacggtcgacctttcggccctgggaccaaagtggatatcaaacgtaagtacatctgtctcaattattcgtgagattttagtgccattgtatcatttgtgcaagttttgtgaggcttgaaagtaacgctgatggcgcgagggaggc

SEQ ID NO: 6125 - DNA, 495 bp, Artificial Sequence
  source: /note="Description of Artificial Sequence: Synthetic polynucleotide"
gccttgccagcccgctcagacacacgtaagtaacgctaatatcagataccagatgtgacatccagatgacccagtctccatcctccctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgggacagatttcactctcaccatcagcagcctgcagcctgaagatgttgcaacttattactgtcaaaagtataacagttgaacacacgtaagtaacggtcgacctttcggccctgggaccaaagtggatatcaaacgtaagtacatctgtctcaattattcgtgagattttagtgccattgtatcatttgtgcaagttttgtgacacacgtaagtaacgctgatggcgcgagggaggc

SEQ ID NO: 6126 - DNA, 495 bp, Artificial Sequence
  source: /note="Description of Artificial Sequence: Synthetic polynucleotide"
gccttgccagcccgctcagtagacggaaagtaacgctaatcgcaggtgccagatgtgacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataattgatagacggaaagtaacggtcgacctttcggccctgggaccaaagtggatatcaaacgtaagtacatctgtctcaattattcgtgagattttagtgccattgtatcatttgtgcaagttttgtgtagacggaaagtaacgctgatggcgcgagggaggc

SEQ ID NO: 6127 - DNA, 495 bp, Artificial Sequence
  source: /note="Description of Artificial Sequence: Synthetic polynucleotide"
gccttgccagcccgctcagcagctcttaagtaacgccaatctcaggtgccagatgtgacatccagttgacccagtctccatcctccctgtctgcatctgtaggagacagagtcaccatcacttgccgggtgagtcagggcattagcagttatttaaattggtatcggcagaaaccagggaaagttcctaagctcctgatctatagtgcatccaatttgcaatctggagtcccatctcggttcagtggcagtggatctgggacagatttcactctcactatcagcagcctgcagcctgaagatgttgcaacttattacggtcaacggacttacaattgacagctcttaagtaacggtcgacctttcggccctgggaccaaagtggatatcaaacgtaagtacatctgtctcaattattcgtgagattttagtgccattgtatcatttgtgcaagttttgtgcagctcttaagtaacgctgatggcgcgagggaggc

SEQ ID NO: 6128 - DNA, 495 bp, Artificial Sequence
  source: /note="Description of Artificial Sequence: Synthetic polynucleotide"
gccttgccagcccgctcaggagcgataaagtaacgccaatctcaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagttgagagcgataaagtaacggtcgacctttcggccctgggaccaaagtggatatcaaacgtaagtacatctgtctcaattattcgtgagattttagtgccattgtatcatttgtgcaagttttgtggagcgataaagtaacgctgatggcgcgagggaggc

SEQ ID NO: 6129 - DNA, 495 bp, Artificial Sequence
  source: /note="Description of Artificial Sequence: Synthetic polynucleotide"
gccttgccagcccgctcaggcatctgaaagtaacgccaatctcaggtaccagatgtgacatccagatgacccagtctccatcctccctgtctgcatctgtaggagacagagtcaccatcacttgccgggcgagtcagggcattagcaattctttagcctggtatcagcagaaaccagggaaagcccctaagctcctgctctatgctgcatccagattggaaagtggggtcccatccaggttcagtggcagtggatctgggacggattacactctcaccatcagcagcctgcagcctgaagattttgcaacttattactgtcaacagtattatagttgagcatctgaaagtaacggtcgacctttcggccctgggaccaaagtggatatcaaacgtaagtacatctgtctcaattattcgtgagattttagtgccattgtatcatttgtgcaagttttgtggcatctgaaagtaacgctgatggcgcgagggaggc

SEQ ID NO: 6130 - DNA, 495 bp, Artificial Sequence
  source: /note="Description of Artificial Sequence: Synthetic polynucleotide"
gccttgccagcccgctcagtgctacacaagtaacgagtggggatattgtgatgacccagactccactctcctcacctgtcacccttggacagccggcctccatctcctgcaggtctagtcaaagcctcgtacacagtgatggaaacacctacttgagttggcttcagcagaggccaggccagcctccaagactcctaatttataagatttctaaccggttctctggggtcccagacagattcagtggcagtggggcagggacagatttcacactgaaaatcagcagggtggaagctgaggatgtcggggtttattactgcatgcaagctacacaatgatgctacacaagtaacggtcgacctttcggccctgggaccaaagtggatatcaaacgtaagtacatctgtctcaattattcgtgagattttagtgccattgtatcatttgtgcaagttttgtgtgctacacaagtaacgctgatggcgcgagggaggc

SEQ ID NO: 6131 - DNA, 495 bp, Artificial Sequence
  source: /note="Description of Artificial Sequence: Synthetic polynucleotide"
gccttgccagcccgctcagaactgccaaagtaacgagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaatgaaactgccaaagtaacggtcgacctttcggccctgggaccaaagtggatatcaaacgtaagtacatctgtctcaattattcgtgagattttagtgccattgtatcatttgtgcaagttttgtgaactgccaaagtaacgctgatggcgcgagggaggc

SEQ ID NO: 6132 - DNA, 495 bp, Artificial Sequence
  source: /note="Description of Artificial Sequence: Synthetic polynucleotide"
gccttgccagcccgctcagttggactgaagtaacgagtgcggatattgtgatgacccagactccactctctctgtccgtcacccctggacagccggcctccatctcctgcaagtctagtcagagcctcctgcatagtgatggaaagacctatttgtattggtacctgcagaagccaggccagtctccacagctcctgatctatgaagtttccagccggttctctggagtgccagataggttcagtggcagcgggtcagggacagatttcacactgaaaatcagccgggtggaggctgaggatgttggggtttattactgaatgcaaggtatacactgattggactgaagtaacggtcgacctttcggccctgggaccaaagtggatatcaaacgtaagtacatctgtctcaattattcgtgagattttagtgccattgtatcatttgtgcaagttttgtgttggactgaagtaacgctgatggcgcgagggaggc

SEQ ID NO: 6133 - DNA, 495 bp, Artificial Sequence
  source: /note="Description of Artificial Sequence: Synthetic polynucleotide"
gccttgccagcccgctcaggtagacacaagtaacgagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactgagtagacacaagtaacggtcgacctttcggccctgggaccaaagtggatatcaaacgtaagtacatctgtctcaattattcgtgagattttagtgccattgtatcatttgtgcaagttttgtggtagacacaagtaacgctgatggcgcgagggaggc

SEQ ID NO: 6134 - DNA, 495 bp, Artificial Sequence
  source: /note="Description of Artificial Sequence: Synthetic polynucleotide"
gccttgccagcccgctcagcactgtacaagtaacggaggatattgtgatgacccagactccactctccctgcccgtcacccctggagagccggcctccatctcctgcaggtctagtcagagcctcttggatagtgatgatggaaacacctatttggactggtacctgcagaagccagggcagtctccacagctcctgatctatacgctttcctatcgggcctctggagtcccagacaggttcagtggcagtgggtcaggcactgatttcacactgaaaatcagcagggtggaggctgaggatgttggagtttattactgcatgcaacgtatagagtgacactgtacaagtaacggtcgacctttcggccctgggaccaaagtggatatcaaacgtaagtacatctgtctcaattattcgtgagattttagtgccattgtatcatttgtgcaagttttgtgcactgtacaagtaacgctgatggcgcgagggaggc

SEQ ID NO: 6135 - DNA, 495 bp, Artificial Sequence
  source: /note="Description of Artificial Sequence: Synthetic polynucleotide"
gccttgccagcccgctcaggatgatccaagtaacgatctcagataccaccggagaaattgtaatgacacagtctccagccaccctgtctttgtctccaggggaaagagccaccctctcctgcagggccagtcagagtgttagcagcagctacttatcctggtaccagcagaaacctgggcaggctcccaggctcctcatctatggtgcatccaccagggccactggcatcccagccaggttcagtggcagtgggtctgggacagacttcactctcaccatcagcagcctgcagcctgaagattttgcagtttattactgtcagcaggattataactgagatgatccaagtaacggtcgacctttcggccctgggaccaaagtggatatcaaacgtaagtacatctgtctcaattattcgtgagattttagtgccattgtatcatttgtgcaagttttgtggatgatccaagtaacgctgatggcgcgagggaggc

SEQ ID NO: 6136 - DNA, 495 bp, Artificial Sequence
  source: /note="Description of Artificial Sequence: Synthetic polynucleotide"
gccttgccagcccgctcagcgccaataaagtaacgccaatttcagataccaccggagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactgacgccaataaagtaacggtcgacctttcggccctgggaccaaagtggatatcaaacgtaagtacatctgtctcaattattcgtgagattttagtgccattgtatcatttgtgcaagttttgtgcgccaataaagtaacgctgatggcgcgagggaggc

SEQ ID NO: 6137 - DNA, 495 bp, Artificial Sequence
  source: /note="Description of Artificial Sequence: Synthetic polynucleotide"
gccttgccagcccgctcagtcaagcctaagtaacgccaatttcagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactgatcaagcctaagtaacggtcgacctttcggccctgggaccaaagtggatatcaaacgtaagtacatctgtctcaattattcgtgagattttagtgccattgtatcatttgtgcaagttttgtgtcaagcctaagtaacgctgatggcgcgagggaggc

SEQ ID NO: 6138 - DNA, 495 bp, Artificial Sequence
  source: /note="Description of Artificial Sequence: Synthetic polynucleotide"
gccttgccagcccgctcagacgtgtgtaagtaacgatctcagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctgaacgtgtgtaagtaacggtcgacctttcggccctgggaccaaagtggatatcaaacgtaagtacatctgtctcaattattcgtgagattttagtgccattgtatcatttgtgcaagttttgtgacgtgtgtaagtaacgctgatggcgcgagggaggc

SEQ ID NO: 6139 - DNA, 495 bp, Artificial Sequence
  source: /note="Description of Artificial Sequence: Synthetic polynucleotide"
gccttgccagcccgctcagtccgtctaaagtaacgccaatttcagataccaccggagaaattgtgttgacacagtctccagccaccctgtctttgtctccaggggaaagagccaccctctcctgcagggccagtcagggtgttagcagctacttagcctggtaccagcagaaacctggccaggctcccaggctcctcatctatgatgcatccaacagggccactggcatcccagccaggttcagtggcagtgggcctgggacagacttcactctcaccatcagcagcctagagcctgaagattttgcagtttattactgtcagcagcgtagcaactgatccgtctaaagtaacggtcgacctttcggccctgggaccaaagtggatatcaaacgtaagtacatctgtctcaattattcgtgagattttagtgccattgtatcatttgtgcaagttttgtgtccgtctaaagtaacgctgatggcgcgagggaggc

SEQ ID NO: 6140 - DNA, 495 bp, Artificial Sequence
  source: /note="Description of Artificial Sequence: Synthetic polynucleotide"
gccttgccagcccgctcagaagagctgaagtaacgggggacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagttgaaagagctgaagtaacggtcgacctttcggccctgggaccaaagtggatatcaaacgtaagtacatctgtctcaattattcgtgagattttagtgccattgtatcatttgtgcaagttttgtgaagagctgaagtaacgctgatggcgcgagggaggc

SEQ ID NO: 6141 - DNA, 495 bp, Artificial Sequence
  source: /note="Description of Artificial Sequence: Synthetic polynucleotide"
gccttgccagcccgctcagtatcgctcaagtaacgccataatcagataccagggcagaaacgacactcacgcagtctccagcattcatgtcagcgactccaggagacaaagtcaacatctcctgcaaagccagccaagacattgatgatgatatgaactggtaccaacagaaaccaggagaagctgctattttcattattcaagaagctactactctcgttcctggaatcccacctcgattcagtggcagcgggtatggaacagattttaccctcacaattaataacatagaatctgaggatgctgcatattacttctgtctacaacatgataattgatatcgctcaagtaacggtcgacctttcggccctgggaccaaagtggatatcaaacgtaagtacatctgtctcaattattcgtgagattttagtgccattgtatcatttgtgcaagttttgtgtatcgctcaagtaacgctgatggcgcgagggaggc

SEQ ID NO: 6142 - DNA, 495 bp, Artificial Sequence
  source: /note="Description of Artificial Sequence: Synthetic polynucleotide"
gccttgccagcccgctcaggttccgaagtctcctaccaatctcaggtgccaaatgtgacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttgagttccgaagtctcctagtcgacctttcggcggagggaccaaggtggagatcaaacgtaagtgcactttcctaatgctttttcttataaggttttaaatttggagcgtttttgtgtttgagatgttccgaagtctcctactgatggcgcgagggaggc

SEQ ID NO: 6143 - DNA, 495 bp, Artificial Sequence
  source: /note="Description of Artificial Sequence: Synthetic polynucleotide"
gccttgccagcccgctcagcgttacttgtctcctaccaatctcaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcctgatctatgctgcatccagtttacaaagtggggtcccatcaaggttcagcggcagtggatctggcacagatttcactctcaccatcagcagcctgcagcctgaagattttgcaacttattactgtctacaagattacaattgacgttacttgtctcctagtcgacctttcggcggagggaccaaggtggagatcaaacgtaagtgcactttcctaatgctttttcttataaggttttaaatttggagcgtttttgtgtttgagatcgttacttgtctcctactgatggcgcgagggaggc

SEQ ID NO: 6144 - DNA, 495 bp, Artificial Sequence
  source: /note="Description of Artificial Sequence: Synthetic polynucleotide"
gccttgccagcccgctcagtaggagacgtctcctaccaatctcaggtgccagatgtgccatccggatgacccagtctccatcctcattctctgcatctacaggagacagagtcaccatcacttgtcgggcgagtcagggtattagcagttatttagcctggtatcagcaaaaaccagggaaagcccctaagctcctgatctatgctgcatccactttgcaaagtggggtcccatcaaggttcagcggcagtggatctgggacagatttcactctcaccatcagctgcctgcagtctgaagattttgcaacttattactgtcaacagtattatagttgataggagacgtctcctagtcgacctttcggcggagggaccaaggtggagatcaaacgtaagtgcactttcctaatgctttttcttataaggttttaaatttggagcgtttttgtgtttgagattaggagacgtctcctactgatggcgcgagggaggc

SEQ ID NO: 6145 - DNA, 495 bp, Artificial Sequence
  source: /note="Description of Artificial Sequence: Synthetic polynucleotide"
gccttgccagcccgctcaggtgtctacgtctcctaccaatctcaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttgagtgtctacgtctcctagtcgacctttcggcggagggaccaaggtggagatcaaacgtaagtgcactttcctaatgctttttcttataaggttttaaatttggagcgtttttgtgtttgagatgtgtctacgtctcctactgatggcgcgagggaggc

SEQ ID NO: 6146 - DNA, 495 bp, Artificial Sequence
  source: /note="Description of Artificial Sequence: Synthetic polynucleotide"
gccttgccagcccgctcaggtacagtggtctcctaccaatctcaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagttgagtacagtggtctcctagtcgacctttcggcggagggaccaaggtggagatcaaacgtaagtgcactttcctaatgctttttcttataaggttttaaatttggagcgtttttgtgtttgagatgtacagtggtctcctactgatggcgcgagggaggc

SEQ ID NO: 6147 - DNA, 495 bp, Artificial Sequence
  source: /note="Description of Artificial Sequence: Synthetic polynucleotide"
gccttgccagcccgctcagggatcatcgtctcctaccaatctcaggtgccagatgtgccatccagttgacccagtctccatcctccctgtctgcatctgtaggagacagagtcaccatcacttgccgggcaagtcagggcattagcagtgctttagcctgatatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaataattgaggatcatcgtctcctagtcgacctttcggcggagggaccaaggtggagatcaaacgtaagtgcactttcctaatgctttttcttataaggttttaaatttggagcgtttttgtgtttgagatggatcatcgtctcctactgatggcgcgagggaggc

SEQ ID NO: 6148 - DNA, 495 bp, Artificial Sequence
  source: /note="Description of Artificial Sequence: Synthetic polynucleotide"
gccttgccagcccgctcagtattggcggtctcctaccaatctcaggtgccagatgtgacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcaacttattactgccaacagtataatagttgatattggcggtctcctagtcgacctttcggcggagggaccaaggtggagatcaaacgtaagtgcactttcctaatgctttttcttataaggttttaaatttggagcgtttttgtgtttgagattattggcggtctcctactgatggcgcgagggaggc

SEQ ID NO: 6149 - DNA, 495 bp, Artificial Sequence
  source: /note="Description of Artificial Sequence: Synthetic polynucleotide"
gccttgccagcccgctcagaggcttgagtctcctaccaatctcaggtgccaggtgtgacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttgaaggcttgagtctcctagtcgacctttcggcggagggaccaaggtggagatcaaacgtaagtgcactttcctaatgctttttcttataaggttttaaatttggagcgtttttgtgtttgagataggcttgagtctcctactgatggcgcgagggaggc

SEQ ID NO: 6150 - DNA, 495 bp, Artificial Sequence
  source: /note="Description of Artificial Sequence: Synthetic polynucleotide"
gccttgccagcccgctcagacacacgtgtctcctactaatatcagataccagatgtgacatccagatgacccagtctccatcctccctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgggacagatttcactctcaccatcagcagcctgcagcctgaagatgttgcaacttattactgtcaaaagtataacagttgaacacacgtgtctcctagtcgacctttcggcggagggaccaaggtggagatcaaacgtaagtgcactttcctaatgctttttcttataaggttttaaatttggagcgtttttgtgtttgagatacacacgtgtctcctactgatggcgcgagggaggc

SEQ ID NO: 6151 - DNA, 495 bp, Artificial Sequence
  source: /note="Description of Artificial Sequence: Synthetic polynucleotide"
gccttgccagcccgctcagtagacggagtctcctactaatcgcaggtgccagatgtgacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataattgatagacggagtctcctagtcgacctttcggcggagggaccaaggtggagatcaaacgtaagtgcactttcctaatgctttttcttataaggttttaaatttggagcgtttttgtgtttgagattagacggagtctcctactgatggcgcgagggaggc

SEQ ID NO: 6152 - DNA, 495 bp, Artificial Sequence
  source: /note="Description of Artificial Sequence: Synthetic polynucleotide"
gccttgccagcccgctcagcagctcttgtctcctaccaatctcaggtgccagatgtgacatccagttgacccagtctccatcctccctgtctgcatctgtaggagacagagtcaccatcacttgccgggtgagtcagggcattagcagttatttaaattggtatcggcagaaaccagggaaagttcctaagctcctgatctatagtgcatccaatttgcaatctggagtcccatctcggttcagtggcagtggatctgggacagatttcactctcactatcagcagcctgcagcctgaagatgttgcaacttattacggtcaacggacttacaattgacagctcttgtctcctagtcgacctttcggcggagggaccaaggtggagatcaaacgtaagtgcactttcctaatgctttttcttataaggttttaaatttggagcgtttttgtgtttgagatcagctcttgtctcctactgatggcgcgagggaggc

SEQ ID NO: 6153 - DNA, 495 bp, Artificial Sequence
  source: /note="Description of Artificial Sequence: Synthetic polynucleotide"
gccttgccagcccgctcaggagcgatagtctcctaccaatctcaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagttgagagcgatagtctcctagtcgacctttcggcggagggaccaaggtggagatcaaacgtaagtgcactttcctaatgctttttcttataaggttttaaatttggagcgtttttgtgtttgagatgagcgatagtctcctactgatggcgcgagggaggc

SEQ ID NO: 6154 - DNA, 495 bp, Artificial Sequence
  source: /note="Description of Artificial Sequence: Synthetic polynucleotide"
gccttgccagcccgctcaggcatctgagtctcctaccaatctcaggtaccagatgtgacatccagatgacccagtctccatcctccctgtctgcatctgtaggagacagagtcaccatcacttgccgggcgagtcagggcattagcaattctttagcctggtatcagcagaaaccagggaaagcccctaagctcctgctctatgctgcatccagattggaaagtggggtcccatccaggttcagtggcagtggatctgggacggattacactctcaccatcagcagcctgcagcctgaagattttgcaacttattactgtcaacagtattatagttgagcatctgagtctcctagtcgacctttcggcggagggaccaaggtggagatcaaacgtaagtgcactttcctaatgctttttcttataaggttttaaatttggagcgtttttgtgtttgagatgcatctgagtctcctactgatggcgcgagggaggc

SEQ ID NO: 6155 - DNA, 495 bp, Artificial Sequence
  source: /note="Description of Artificial Sequence: Synthetic polynucleotide"
gccttgccagcccgctcagtgctacacgtctcctaagtggggatattgtgatgacccagactccactctcctcacctgtcacccttggacagccggcctccatctcctgcaggtctagtcaaagcctcgtacacagtgatggaaacacctacttgagttggcttcagcagaggccaggccagcctccaagactcctaatttataagatttctaaccggttctctggggtcccagacagattcagtggcagtggggcagggacagatttcacactgaaaatcagcagggtggaagctgaggatgtcggggtttattactgcatgcaagctacacaatgatgctacacgtctcctagtcgacctttcggcggagggaccaaggtggagatcaaacgtaagtgcactttcctaatgctttttcttataaggttttaaatttggagcgtttttgtgtttgagattgctacacgtctcctactgatggcgcgagggaggc

SEQ ID NO: 6156 - DNA, 495 bp, Artificial Sequence
  source: /note="Description of Artificial Sequence: Synthetic polynucleotide"
gccttgccagcccgctcagaactgccagtctcctaagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaatgaaactgccagtctcctagtcgacctttcggcggagggaccaaggtggagatcaaacgtaagtgcactttcctaatgctttttcttataaggttttaaatttggagcgtttttgtgtttgagataactgccagtctcctactgatggcgcgagggaggc

SEQ ID NO: 6157 - DNA, 495 bp, Artificial Sequence
  source: /note="Description of Artificial Sequence: Synthetic polynucleotide"
gccttgccagcccgctcagttggactggtctcctaagtgcggatattgtgatgacccagactccactctctctgtccgtcacccctggacagccggcctccatctcctgcaagtctagtcagagcctcctgcatagtgatggaaagacctatttgtattggtacctgcagaagccaggccagtctccacagctcctgatctatgaagtttccagccggttctctggagtgccagataggttcagtggcagcgggtcagggacagatttcacactgaaaatcagccgggtggaggctgaggatgttggggtttattactgaatgcaaggtatacactgattggactggtctcctagtcgacctttcggcggagggaccaaggtggagatcaaacgtaagtgcactttcctaatgctttttcttataaggttttaaatttggagcgtttttgtgtttgagatttggactggtctcctactgatggcgcgagggaggc

SEQ ID NO: 6158 - DNA, 495 bp, Artificial Sequence
  source: /note="Description of Artificial Sequence: Synthetic polynucleotide"
gccttgccagcccgctcaggtagacacgtctcctaagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactgagtagacacgtctcctagtcgacctttcggcggagggaccaaggtggagatcaaacgtaagtgcactttcctaatgctttttcttataaggttttaaatttggagcgtttttgtgtttgagatgtagacacgtctcctactgatggcgcgagggaggc

SEQ ID NO: 6159 - DNA, 495 bp, Artificial Sequence
  source: /note="Description of Artificial Sequence: Synthetic polynucleotide"
gccttgccagcccgctcagcactgtacgtctcctagaggatattgtgatgacccagactccactctccctgcccgtcacccctggagagccggcctccatctcctgcaggtctagtcagagcctcttggatagtgatgatggaaacacctatttggactggtacctgcagaagccagggcagtctccacagctcctgatctatacgctttcctatcgggcctctggagtcccagacaggttcagtggcagtgggtcaggcactgatttcacactgaaaatcagcagggtggaggctgaggatgttggagtttattactgcatgcaacgtatagagtgacactgtacgtctcctagtcgacctttcggcggagggaccaaggtggagatcaaacgtaagtgcactttcctaatgctttttcttataaggttttaaatttggagcgtttttgtgtttgagatcactgtacgtctcctactgatggcgcgagggaggc

SEQ ID NO: 6160 - DNA, 495 bp, Artificial Sequence
  source: /note="Description of Artificial Sequence: Synthetic polynucleotide"
gccttgccagcccgctcaggatgatccgtctcctaatctcagataccaccggagaaattgtaatgacacagtctccagccaccctgtctttgtctccaggggaaagagccaccctctcctgcagggccagtcagagtgttagcagcagctacttatcctggtaccagcagaaacctgggcaggctcccaggctcctcatctatggtgcatccaccagggccactggcatcccagccaggttcagtggcagtgggtctgggacagacttcactctcaccatcagcagcctgcagcctgaagattttgcagtttattactgtcagcaggattataactgagatgatccgtctcctagtcgacctttcggcggagggaccaaggtggagatcaaacgtaagtgcactttcctaatgctttttcttataaggttttaaatttggagcgtttttgtgtttgagatgatgatccgtctcctactgatggcgcgagggaggc

SEQ ID NO: 6161 - DNA, 495 bp, Artificial Sequence
  source: /note="Description of Artificial Sequence: Synthetic polynucleotide"
gccttgccagcccgctcagcgccaatagtctcctaccaatttcagataccaccggagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactgacgccaatagtctcctagtcgacctttcggcggagggaccaaggtggagatcaaacgtaagtgcactttcctaatgctttttcttataaggttttaaatttggagcgtttttgtgtttgagatcgccaatagtctcctactgatggcgcgagggaggc

SEQ ID NO: 6162 - DNA, 495 bp, Artificial Sequence
  source: /note="Description of Artificial Sequence: Synthetic polynucleotide"
gccttgccagcccgctcagtcaagcctgtctcctaccaatttcagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactgatcaagcctgtctcctagtcgacctttcggcggagggaccaaggtggagatcaaacgtaagtgcactttcctaatgctttttcttataaggttttaaatttggagcgtttttgtgtttgagattcaagcctgtctcctactgatggcgcgagggaggc

SEQ ID NO: 6163 - DNA, 495 bp, Artificial Sequence
  source: /note="Description of Artificial Sequence: Synthetic polynucleotide"
gccttgccagcccgctcagacgtgtgtgtctcctaatctcagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctgaacgtgtgtgtctcctagtcgacctttcggcggagggaccaaggtggagatcaaacgtaagtgcactttcctaatgctttttcttataaggttttaaatttggagcgtttttgtgtttgagatacgtgtgtgtctcctactgatggcgcgagggaggc

SEQ ID NO: 6164 - DNA, 495 bp, Artificial Sequence
  source: /note="Description of Artificial Sequence: Synthetic polynucleotide"
gccttgccagcccgctcagtccgtctagtctcctaccaatttcagataccaccggagaaattgtgttgacacagtctccagccaccctgtctttgtctccaggggaaagagccaccctctcctgcagggccagtcagggtgttagcagctacttagcctggtaccagcagaaacctggccaggctcccaggctcctcatctatgatgcatccaacagggccactggcatcccagccaggttcagtggcagtgggcctgggacagacttcactctcaccatcagcagcctagagcctgaagattttgcagtttattactgtcagcagcgtagcaactgatccgtctagtctcctagtcgacctttcggcggagggaccaaggtggagatcaaacgtaagtgcactttcctaatgctttttcttataaggttttaaatttggagcgtttttgtgtttgagattccgtctagtctcctactgatggcgcgagggaggc

SEQ ID NO: 6165 - DNA, 495 bp, Artificial Sequence
  source: /note="Description of Artificial Sequence: Synthetic polynucleotide"
gccttgccagcccgctcagaagagctggtctcctaggggacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagttgaaagagctggtctcctagtcgacctttcggcggagggaccaaggtggagatcaaacgtaagtgcactttcctaatgctttttcttataaggttttaaatttggagcgtttttgtgtttgagataagagctggtctcctactgatggcgcgagggaggc

SEQ ID NO: 6166 - DNA, 495 bp, Artificial Sequence
  source: /note="Description of Artificial Sequence: Synthetic polynucleotide"
gccttgccagcccgctcagtatcgctcgtctcctaccataatcagataccagggcagaaacgacactcacgcagtctccagcattcatgtcagcgactccaggagacaaagtcaacatctcctgcaaagccagccaagacattgatgatgatatgaactggtaccaacagaaaccaggagaagctgctattttcattattcaagaagctactactctcgttcctggaatcccacctcgattcagtggcagcgggtatggaacagattttaccctcacaattaataacatagaatctgaggatgctgcatattacttctgtctacaacatgataattgatatcgctcgtctcctagtcgacctttcggcggagggaccaaggtggagatcaaacgtaagtgcactttcctaatgctttttcttataaggttttaaatttggagcgtttttgtgtttgagattatcgctcgtctcctactgatggcgcgagggaggc

SEQ ID NO: 6167 - DNA, 495 bp, Artificial Sequence
  source: /note="Description of Artificial Sequence: Synthetic polynucleotide"
gccttgccagcccgctcaggttccgaaagagtgtcccaatctcaggtgccaaatgtgacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttgagttccgaaagagtgtcgtcgacccttcggccaagggacacgactggagattaaacgtaagtaatttttcactattgtcttctgaaatttgggtctgatggccagtattgacttttagaggctgttccgaaagagtgtcctgatggcgcgagggaggc

SEQ ID NO: 6168 - DNA, 495 bp, Artificial Sequence
  source: /note="Description of Artificial Sequence: Synthetic polynucleotide"
gccttgccagcccgctcagcgttacttagagtgtcccaatctcaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcctgatctatgctgcatccagtttacaaagtggggtcccatcaaggttcagcggcagtggatctggcacagatttcactctcaccatcagcagcctgcagcctgaagattttgcaacttattactgtctacaagattacaattgacgttacttagagtgtcgtcgacccttcggccaagggacacgactggagattaaacgtaagtaatttttcactattgtcttctgaaatttgggtctgatggccagtattgacttttagaggctcgttacttagagtgtcctgatggcgcgagggaggc

SEQ ID NO: 6169 - DNA, 495 bp, Artificial Sequence
  source: /note="Description of Artificial Sequence: Synthetic polynucleotide"
gccttgccagcccgctcagtaggagacagagtgtcccaatctcaggtgccagatgtgccatccggatgacccagtctccatcctcattctctgcatctacaggagacagagtcaccatcacttgtcgggcgagtcagggtattagcagttatttagcctggtatcagcaaaaaccagggaaagcccctaagctcctgatctatgctgcatccactttgcaaagtggggtcccatcaaggttcagcggcagtggatctgggacagatttcactctcaccatcagctgcctgcagtctgaagattttgcaacttattactgtcaacagtattatagttgataggagacagagtgtcgtcgacccttcggccaagggacacgactggagattaaacgtaagtaatttttcactattgtcttctgaaatttgggtctgatggccagtattgacttttagaggcttaggagacagagtgtcctgatggcgcgagggaggc

SEQ ID NO: 6170 - DNA, 495 bp, Artificial Sequence
  source: /note="Description of Artificial Sequence: Synthetic polynucleotide"
gccttgccagcccgctcaggtgtctacagagtgtcccaatctcaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttgagtgtctacagagtgtcgtcgacccttcggccaagggacacgactggagattaaacgtaagtaatttttcactattgtcttctgaaatttgggtctgatggccagtattgacttttagaggctgtgtctacagagtgtcctgatggcgcgagggaggc

SEQ ID NO: 6171 - DNA, 495 bp, Artificial Sequence
  source: /note="Description of Artificial Sequence: Synthetic polynucleotide"
gccttgccagcccgctcaggtacagtgagagtgtcccaatctcaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagttgagtacagtgagagtgtcgtcgacccttcggccaagggacacgactggagattaaacgtaagtaatttttcactattgtcttctgaaatttgggtctgatggccagtattgacttttagaggctgtacagtgagagtgtcctgatggcgcgagggaggc

SEQ ID NO: 6172 - DNA, 495 bp, Artificial Sequence
  source: /note="Description of Artificial Sequence: Synthetic polynucleotide"
gccttgccagcccgctcagggatcatcagagtgtcccaatctcaggtgccagatgtgccatccagttgacccagtctccatcctccctgtctgcatctgtaggagacagagtcaccatcacttgccgggcaagtcagggcattagcagtgctttagcctgatatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaataattgaggatcatcagagtgtcgtcgacccttcggccaagggacacgactggagattaaacgtaagtaatttttcactattgtcttctgaaatttgggtctgatggccagtattgacttttagaggctggatcatcagagtgtcctgatggcgcgagggaggc

SEQ ID NO: 6173 - DNA, 495 bp, Artificial Sequence
  source: /note="Description of Artificial Sequence: Synthetic polynucleotide"
gccttgccagcccgctcagtattggcgagagtgtcccaatctcaggtgccagatgtgacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcaacttattactgccaacagtataatagttgatattggcgagagtgtcgtcgacccttcggccaagggacacgactggagattaaacgtaagtaatttttcactattgtcttctgaaatttgggtctgatggccagtattgacttttagaggcttattggcgagagtgtcctgatggcgcgagggaggc

SEQ ID NO: 6174 - DNA, 495 bp, Artificial Sequence
  source: /note="Description of Artificial Sequence: Synthetic polynucleotide"
gccttgccagcccgctcagaggcttgaagagtgtcccaatctcaggtgccaggtgtgacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttgaaggcttgaagagtgtcgtcgacccttcggccaagggacacgactggagattaaacgtaagtaatttttcactattgtcttctgaaatttgggtctgatggccagtattgacttttagaggctaggcttgaagagtgtcctgatggcgcgagggaggc

SEQ ID NO: 6175 - DNA, 495 bp, Artificial Sequence
  source: /note="Description of Artificial Sequence: Synthetic polynucleotide"
gccttgccagcccgctcagacacacgtagagtgtcctaatatcagataccagatgtgacatccagatgacccagtctccatcctccctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgggacagatttcactctcaccatcagcagcctgcagcctgaagatgttgcaacttattactgtcaaaagtataacagttgaacacacgtagagtgtcgtcgacccttcggccaagggacacgactggagattaaacgtaagtaatttttcactattgtcttctgaaatttgggtctgatggccagtattgacttttagaggctacacacgtagagtgtcctgatggcgcgagggaggc

SEQ ID NO: 6176 - DNA, 495 bp, Artificial Sequence
  source: /note="Description of Artificial Sequence: Synthetic polynucleotide"
gccttgccagcccgctcagtagacggaagagtgtcctaatcgcaggtgccagatgtgacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataattgatagacggaagagtgtcgtcgacccttcggccaagggacacgactggagattaaacgtaagtaatttttcactattgtcttctgaaatttgggtctgatggccagtattgacttttagaggcttagacggaagagtgtcctgatggcgcgagggaggc

SEQ ID NO: 6177 - DNA, 495 bp, Artificial Sequence
  source: /note="Description of Artificial Sequence: Synthetic polynucleotide"
gccttgccagcccgctcagcagctcttagagtgtcccaatctcaggtgccagatgtgacatccagttgacccagtctccatcctccctgtctgcatctgtaggagacagagtcaccatcacttgccgggtgagtcagggcattagcagttatttaaattggtatcggcagaaaccagggaaagttcctaagctcctgatctatagtgcatccaatttgcaatctggagtcccatctcggttcagtggcagtggatctgggacagatttcactctcactatcagcagcctgcagcctgaagatgttgcaacttattacggtcaacggacttacaattgacagctcttagagtgtcgtcgacccttcggccaagggacacgactggagattaaacgtaagtaatttttcactattgtcttctgaaatttgggtctgatggccagtattgacttttagaggctcagctcttagagtgtcctgatggcgcgagggaggc

SEQ ID NO: 6178 - DNA, 495 bp, Artificial Sequence
  source: /note="Description of Artificial Sequence: Synthetic polynucleotide"
gccttgccagcccgctcaggagcgataagagtgtcccaatctcaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagttgagagcgataagagtgtcgtcgacccttcggccaagggacacgactggagattaaacgtaagtaatttttcactattgtcttctgaaatttgggtctgatggccagtattgacttttagaggctgagcgataagagtgtcctgatggcgcgagggaggc

SEQ ID NO: 6179 - DNA, 495 bp, Artificial Sequence
  source: /note="Description of Artificial Sequence: Synthetic polynucleotide"
gccttgccagcccgctcaggcatctgaagagtgtcccaatctcaggtaccagatgtgacatccagatgacccagtctccatcctccctgtctgcatctgtaggagacagagtcaccatcacttgccgggcgagtcagggcattagcaattctttagcctggtatcagcagaaaccagggaaagcccctaagctcctgctctatgctgcatccagattggaaagtggggtcccatccaggttcagtggcagtggatctgggacggattacactctcaccatcagcagcctgcagcctgaagattttgcaacttattactgtcaacagtattatagttgagcatctgaagagtgtcgtcgacccttcggccaagggacacgactggagattaaacgtaagtaatttttcactattgtcttctgaaatttgggtctgatggccagtattgacttttagaggctgcatctgaagagtgtcctgatggcgcgagggaggc

SEQ ID NO: 6180 - DNA, 495 bp, Artificial Sequence
  source: /note="Description of Artificial Sequence: Synthetic polynucleotide"
gccttgccagcccgctcagtgctacacagagtgtcagtggggatattgtgatgacccagactccactctcctcacctgtcacccttggacagccggcctccatctcctgcaggtctagtcaaagcctcgtacacagtgatggaaacacctacttgagttggcttcagcagaggccaggccagcctccaagactcctaatttataagatttctaaccggttctctggggtcccagacagattcagtggcagtggggcagggacagatttcacactgaaaatcagcagggtggaagctgaggatgtcggggtttattactgcatgcaagctacacaatgatgctacacagagtgtcgtcgacccttcggccaagggacacgactggagattaaacgtaagtaatttttcactattgtcttctgaaatttgggtctgatggccagtattgacttttagaggcttgctacacagagtgtcctgatggcgcgagggaggc

SEQ ID NO: 6181 - DNA, 495 bp, Artificial Sequence
  source: /note="Description of Artificial Sequence: Synthetic polynucleotide"
gccttgccagcccgctcagaactgccaagagtgtcagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaatgaaactgccaagagtgtcgtcgacccttcggccaagggacacgactggagattaaacgtaagtaatttttcactattgtcttctgaaatttgggtctgatggccagtattgacttttagaggctaactgccaagagtgtcctgatggcgcgagggaggc

SEQ ID NO: 6182 - DNA, 495 bp, Artificial Sequence
  source: /note="Description of Artificial Sequence: Synthetic polynucleotide"
gccttgccagcccgctcagttggactgagagtgtcagtgcggatattgtgatgacccagactccactctctctgtccgtcacccctggacagccggcctccatctcctgcaagtctagtcagagcctcctgcatagtgatggaaagacctatttgtattggtacctgcagaagccaggccagtctccacagctcctgatctatgaagtttccagccggttctctggagtgccagataggttcagtggcagcgggtcagggacagatttcacactgaaaatcagccgggtggaggctgaggatgttggggtttattactgaatgcaaggtatacactgattggactgagagtgtcgtcgacccttcggccaagggacacgactggagattaaacgtaagtaatttttcactattgtcttctgaaatttgggtctgatggccagtattgacttttagaggctttggactgagagtgtcctgatggcgcgagggaggc

SEQ ID NO: 6183 - DNA, 495 bp, Artificial Sequence
  source: /note="Description of Artificial Sequence: Synthetic polynucleotide"
gccttgccagcccgctcaggtagacacagagtgtcagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactgagtagacacagagtgtcgtcgacccttcggccaagggacacgactggagattaaacgtaagtaatttttcactattgtcttctgaaatttgggtctgatggccagtattgacttttagaggctgtagacacagagtgtcctgatggcgcgagggaggc

SEQ ID NO: 6184 - DNA, 495 bp, Artificial Sequence
  source: /note="Description of Artificial Sequence: Synthetic polynucleotide"
gccttgccagcccgctcagcactgtacagagtgtcgaggatattgtgatgacccagactccactctccctgcccgtcacccctggagagccggcctccatctcctgcaggtctagtcagagcctcttggatagtgatgatggaaacacctatttggactggtacctgcagaagccagggcagtctccacagctcctgatctatacgctttcctatcgggcctctggagtcccagacaggttcagtggcagtgggtcaggcactgatttcacactgaaaatcagcagggtggaggctgaggatgttggagtttattactgcatgcaacgtatagagtgacactgtacagagtgtcgtcgacccttcggccaagggacacgactggagattaaacgtaagtaatttttcactattgtcttctgaaatttgggtctgatggccagtattgacttttagaggctcactgtacagagtgtcctgatggcgcgagggaggc

SEQ ID NO: 6185 - DNA, 495 bp, Artificial Sequence
  source: /note="Description of Artificial Sequence: Synthetic polynucleotide"
gccttgccagcccgctcaggatgatccagagtgtcatctcagataccaccggagaaattgtaatgacacagtctccagccaccctgtctttgtctccaggggaaagagccaccctctcctgcagggccagtcagagtgttagcagcagctacttatcctggtaccagcagaaacctgggcaggctcccaggctcctcatctatggtgcatccaccagggccactggcatcccagccaggttcagtggcagtgggtctgggacagacttcactctcaccatcagcagcctgcagcctgaagattttgcagtttattactgtcagcaggattataactgagatgatccagagtgtcgtcgacccttcggccaagggacacgactggagattaaacgtaagtaatttttcactattgtcttctgaaatttgggtctgatggccagtattgacttttagaggctgatgatccagagtgtcctgatggcgcgagggaggc

SEQ ID NO: 6186 - DNA, 495 bp, Artificial Sequence
  source: /note="Description of Artificial Sequence: Synthetic polynucleotide"
gccttgccagcccgctcagcgccaataagagtgtcccaatttcagataccaccggagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactgacgccaataagagtgtcgtcgacccttcggccaagggacacgactggagattaaacgtaagtaatttttcactattgtcttctgaaatttgggtctgatggccagtattgacttttagaggctcgccaataagagtgtcctgatggcgcgagggaggc

SEQ ID NO: 6187 - DNA, 495 bp, Artificial Sequence
  source: /note="Description of Artificial Sequence: Synthetic polynucleotide"
gccttgccagcccgctcagtcaagcctagagtgtcccaatttcagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactgatcaagcctagagtgtcgtcgacccttcggccaagggacacgactggagattaaacgtaagtaatttttcactattgtcttctgaaatttgggtctgatggccagtattgacttttagaggcttcaagcctagagtgtcctgatggcgcgagggaggc

SEQ ID NO: 6188 - DNA, 495 bp, Artificial Sequence
  source: /note="Description of Artificial Sequence: Synthetic polynucleotide"
gccttgccagcccgctcagacgtgtgtagagtgtcatctcagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctgaacgtgtgtagagtgtcgtcgacccttcggccaagggacacgactggagattaaacgtaagtaatttttcactattgtcttctgaaatttgggtctgatggccagtattgacttttagaggctacgtgtgtagagtgtcctgatggcgcgagggaggc

SEQ ID NO: 6189 - DNA, 495 bp, Artificial Sequence
  source: /note="Description of Artificial Sequence: Synthetic polynucleotide"
gccttgccagcccgctcagtccgtctaagagtgtcccaatttcagataccaccggagaaattgtgttgacacagtctccagccaccctgtctttgtctccaggggaaagagccaccctctcctgcagggccagtcagggtgttagcagctacttagcctggtaccagcagaaacctggccaggctcccaggctcctcatctatgatgcatccaacagggccactggcatcccagccaggttcagtggcagtgggcctgggacagacttcactctcaccatcagcagcctagagcctgaagattttgcagtttattactgtcagcagcgtagcaactgatccgtctaagagtgtcgtcgacccttcggccaagggacacgactggagattaaacgtaagtaatttttcactattgtcttctgaaatttgggtctgatggccagtattgacttttagaggcttccgtctaagagtgtcctgatggcgcgagggaggc

SEQ ID NO: 6190 - DNA, 495 bp, Artificial Sequence
  source: /note="Description of Artificial Sequence: Synthetic polynucleotide"
gccttgccagcccgctcagaagagctgagagtgtcggggacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagttgaaagagctgagagtgtcgtcgacccttcggccaagggacacgactggagattaaacgtaagtaatttttcactattgtcttctgaaatttgggtctgatggccagtattgacttttagaggctaagagctgagagtgtcctgatggcgcgagggaggc

SEQ ID NO: 6191 - DNA, 495 bp, Artificial Sequence
  source: /note="Description of Artificial Sequence: Synthetic polynucleotide"
gccttgccagcccgctcagtatcgctcagagtgtcccataatcagataccagggcagaaacgacactcacgcagtctccagcattcatgtcagcgactccaggagacaaagtcaacatctcctgcaaagccagccaagacattgatgatgatatgaactggtaccaacagaaaccaggagaagctgctattttcattattcaagaagctactactctcgttcctggaatcccacctcgattcagtggcagcgggtatggaacagattttaccctcacaattaataacatagaatctgaggatgctgcatattacttctgtctacaacatgataattgatatcgctcagagtgtcgtcgacccttcggccaagggacacgactggagattaaacgtaagtaatttttcactattgtcttctgaaatttgggtctgatggccagtattgacttttagaggcttatcgctcagagtgtcctgatggcgcgagggaggc

SEQ ID NO: 6192 - DNA, 49 bp, Artificial Sequence
  source: /note="Description of Artificial Sequence: Synthetic primer"
gggctggcaagccacgtttggtggaatgccctgacagctctcgcttata

SEQ ID NO: 6193 - DNA, 64 bp, Artificial Sequence
  source: /note="Description of Artificial Sequence: Synthetic primer"
gggctggcaagccacgtttggtgctcagagaagtctgaaatattcgatgatcaattctcagttg

SEQ ID NO: 6194 - DNA, 57 bp, Artificial Sequence
  source: /note="Description of Artificial Sequence: Synthetic primer"
gggctggcaagccacgtttggtgccaaatcgmttctcacctaaatctccagacaaag

SEQ ID NO: 6195 - DNA, 49 bp, Artificial Sequence
  source: /note="Description of Artificial Sequence: Synthetic primer"
gggctggcaagccacgtttggtgcacctgactctccagacaaagctcat

SEQ ID NO: 6196 - DNA, 45 bp, Artificial Sequence
  source: /note="Description of Artificial Sequence: Synthetic primer"
gggctggcaagccacgtttggtgcctgaatgccccaacagctctc

SEQ ID NO: 6197 - DNA, 47 bp, Artificial Sequence
  source: /note="Description of Artificial Sequence: Synthetic primer"
gggctggcaagccacgtttggtggattctcagggcgccagttctcta

SEQ ID NO: 6198 - DNA, 54 bp, Artificial Sequence
  source: /note="Description of Artificial Sequence: Synthetic primer"
gggctggcaagccacgtttggtgcctaattgattctcagctcaccacgtccata

SEQ ID NO: 6199 - DNA, 42 bp, Artificial Sequence
  source: /note="Description of Artificial Sequence: Synthetic primer"
gggctggcaagccacgtttggtgtcagggcgccagttccatg

SEQ ID NO: 6200 - DNA, 52 bp, Artificial Sequence
  source: /note="Description of Artificial Sequence: Synthetic primer"
gggctggcaagccacgtttggtgtcctagattctcaggtctccagttcccta

SEQ ID NO: 6201 - DNA, 51 bp, Artificial Sequence
  source: /note="Description of Artificial Sequence: Synthetic primer"
gggctggcaagccacgtttggtggaggaaacttccctgatcgattctcagc

SEQ ID NO: 6202 - DNA, 50 bp, Artificial Sequence
  source: /note="Description of Artificial Sequence: Synthetic primer"
gggctggcaagccacgtttggtgcaacttccctgatcgattctcaggtca

SEQ ID NO: 6203 - DNA, 53 bp, Artificial Sequence
  source: /note="Description of Artificial Sequence: Synthetic primer"
gggctggcaagccacgtttggtgaggaaacttccctgatcaattctcaggtca

SEQ ID NO: 6204 - DNA, 52 bp, Artificial Sequence
  source: /note="Description of Artificial Sequence: Synthetic primer"
gggctggcaagccacgtttggtgggaaacttccctcctagattttcaggtcg

SEQ ID NO: 6205 - DNA, 50 bp, Artificial Sequence
  source: /note="Description of Artificial Sequence: Synthetic primer"
gggctggcaagccacgtttggtgccccaatggctacaatgtctccagatt

SEQ ID NO: 6206 - DNA, 46 bp, Artificial Sequence
  source: /note="Description of Artificial Sequence: Synthetic primer"
gggctggcaagccacgtttggtgggagaggtccctgatggctacaa

SEQ ID NO: 6207 - DNA, 51 bp, Artificial Sequence
  source: /note="Description of Artificial Sequence: Synthetic primer"
gggctggcaagccacgtttggtgtccctgatggttatagtgtctccagagc

SEQ ID NO: 6208 - DNA, 50 bp, Artificial Sequence
  source: /note="Description of Artificial Sequence: Synthetic primer"
gggctggcaagccacgtttggtgggagaagtccccaatggctacaatgtc

SEQ ID NO: 6209 - DNA, 49 bp, Artificial Sequence
  source: /note="Description of Artificial Sequence: Synthetic primer"
gggctggcaagccacgtttggtgaaaggagaagtcccgaatggctacaa

SEQ ID NO: 6210 - DNA, 52 bp, Artificial Sequence
  source: /note="Description of Artificial Sequence: Synthetic primer"
gggctggcaagccacgtttggtggttcccaatggctacaatgtctccagatc

SEQ ID NO: 6211 - DNA, 55 bp, Artificial Sequence
  source: /note="Description of Artificial Sequence: Synthetic primer"
gggctggcaagccacgtttggtggaagtccccaatggctacaatgtctctagatt

SEQ ID NO: 6212 - DNA, 49 bp, Artificial Sequence
  source: /note="Description of Artificial Sequence: Synthetic primer"
gggctggcaagccacgtttggtggagaagtccccgatggctacaatgta

SEQ ID NO: 6213 - DNA, 47 bp, Artificial Sequence
  source: /note="Description of Artificial Sequence: Synthetic primer"
gggctggcaagccacgtttggtggtgatcggttctctgcacagaggt

SEQ ID NO: 6214 - DNA, 46 bp, Artificial Sequence
  source: /note="Description of Artificial Sequence: Synthetic primer"
gggctggcaagccacgtttggtgcgcttctctgcagagaggactgg

SEQ ID NO: 6215 - DNA, 45 bp, Artificial Sequence
  source: /note="Description of Artificial Sequence: Synthetic primer"
gggctggcaagccacgtttggtgggttctttgcagtcaggcctga

SEQ ID NO: 6216 - DNA, 45 bp, Artificial Sequence
  source: /note="Description of Artificial Sequence: Synthetic primer"
gggctggcaagccacgtttggtgcagtggtcggttctctgcagag

SEQ ID NO: 6217 - DNA, 52 bp, Artificial Sequence
  source: /note="Description of Artificial Sequence: Synthetic primer"
gggctggcaagccacgtttggtggctcagtgatcaattctccacagagaggt

SEQ ID NO: 6218 - DNA, 45 bp, Artificial Sequence
  source: /note="Description of Artificial Sequence: Synthetic primer"
gggctggcaagccacgtttggtgttctctgcagagaggcctgagg

SEQ ID NO: 6219 - DNA, 48 bp, Artificial Sequence
  source: /note="Description of Artificial Sequence: Synthetic primer"
gggctggcaagccacgtttggtgcccagtgatcgcttctttgcagaaa

SEQ ID NO: 6220 - DNA, 46 bp, Artificial Sequence
  source: /note="Description of Artificial Sequence: Synthetic primer"
gggctggcaagccacgtttggtgctgcagagaggcctaagggatct

SEQ ID NO: 6221 - DNA, 56 bp, Artificial Sequence
  source: /note="Description of Artificial Sequence: Synthetic primer"
gggctggcaagccacgtttggtggaagggtacaatgtctctggaaacaaactcaag

SEQ ID NO: 6222 - DNA, 54 bp, Artificial Sequence
  source: /note="Description of Artificial Sequence: Synthetic primer"
gggctggcaagccacgtttggtgggggtactgtgtttcttgaaacaagcttgag

SEQ ID NO: 6223 - DNA, 53 bp, Artificial Sequence
  source: /note="Description of Artificial Sequence: Synthetic primer"
gggctggcaagccacgtttggtgcagttccctgacttgcactctgaactaaac

SEQ ID NO: 6224 - DNA, 55 bp, Artificial Sequence
  source: /note="Description of Artificial Sequence: Synthetic primer"
gggctggcaagccacgtttggtgactaacaaaggagaagtctcagatggctacag

SEQ ID NO: 6225 - DNA, 50 bp, Artificial Sequence
  source: /note="Description of Artificial Sequence: Synthetic primer"
gggctggcaagccacgtttggtgagataaaggagaagtccccgatggcta

SEQ ID NO: 6226 - DNA, 58 bp, Artificial Sequence
  source: /note="Description of Artificial Sequence: Synthetic primer"
gggctggcaagccacgtttggtggatactgacaaaggagaagtctcagatggctatag

SEQ ID NO: 6227 - DNA, 52 bp, Artificial Sequence
  source: /note="Description of Artificial Sequence: Synthetic primer"
gggctggcaagccacgtttggtgctaaggatcgattttctgcagagaggctc

SEQ ID NO: 6228 - DNA, 50 bp, Artificial Sequence
  source: /note="Description of Artificial Sequence: Synthetic primer"
gggctggcaagccacgtttggtgttgattctcagcacagatgcctgatgt

SEQ ID NO: 6229 - DNA, 47 bp, Artificial Sequence
  source: /note="Description of Artificial Sequence: Synthetic primer"
gggctggcaagccacgtttggtgattctcagctgagaggcctgatgg

SEQ ID NO: 6230 - DNA, 53 bp, Artificial Sequence
  source: /note="Description of Artificial Sequence: Synthetic primer"
gggctggcaagccacgtttggtgggatcgattctcagctaagatgcctaatgc

SEQ ID NO: 6231 - DNA, 51 bp, Artificial Sequence
  source: /note="Description of Artificial Sequence: Synthetic primer"
gggctggcaagccacgtttggtgctcagcagagatgcctgatgcaacttta

SEQ ID NO: 6232 - DNA, 52 bp, Artificial Sequence
  source: /note="Description of Artificial Sequence: Synthetic primer"
gggctggcaagccacgtttggtgctgatcgattctcagctcaacagttcagt

SEQ ID NO: 6233 - DNA, 49 bp, Artificial Sequence
  source: /note="Description of Artificial Sequence: Synthetic primer"
gggctggcaagccacgtttggtgtagctgaaaggactggagggacgtat

SEQ ID NO: 6234 - DNA, 47 bp, Artificial Sequence
  source: /note="Description of Artificial Sequence: Synthetic primer"
gggctggcaagccacgtttggtgccaggaggccgaacacttctttct

SEQ ID NO: 6235 - DNA, 48 bp, Artificial Sequence
  source: /note="Description of Artificial Sequence: Synthetic primer"
gggctggcaagccacgtttggtggctaagtgcctcccaaattcaccct

SEQ ID NO: 6236 - DNA, 49 bp, Artificial Sequence
  source: /note="Description of Artificial Sequence: Synthetic primer"
gggctggcaagccacgtttggtgcacagctgaaagacctaacggaacgt

SEQ ID NO: 6237 - DNA, 47 bp, Artificial Sequence
  source: /note="Description of Artificial Sequence: Synthetic primer"
gggctggcaagccacgtttggtgctgctgaatttcccaaagagggcc

SEQ ID NO: 6238 - DNA, 43 bp, Artificial Sequence
  source: /note="Description of Artificial Sequence: Synthetic primer"
gggctggcaagccacgtttggtgagggtacagcgtctctcggg

SEQ ID NO: 6239 - DNA, 46 bp, Artificial Sequence
  source: /note="Description of Artificial Sequence: Synthetic primer"
gggctggcaagccacgtttggtggcctgaccttgtccactctgaca

SEQ ID NO: 6240 - DNA, 50 bp, Artificial Sequence
  source: /note="Description of Artificial Sequence: Synthetic primer"
gggctggcaagccacgtttggtgatgagcgatttttagcccaatgctcca

SEQ ID NO: 6241 - DNA, 47 bp, Artificial Sequence
  source: /note="Description of Artificial Sequence: Synthetic primer"
gggctggcaagccacgtttggtgtgaaggctacgtgtctgccaagag

SEQ ID NO: 6242 - DNA, 47 bp, Artificial Sequence
  source: /note="Description of Artificial Sequence: Synthetic primer"
gggctggcaagccacgtttggtgctcatctcaatgccccaagaacgc

SEQ ID NO: 6243 - DNA, 54 bp, Artificial Sequence
  source: /note="Description of Artificial Sequence: Synthetic primer"
gggctggcaagccacgtttggtgagatctctgatggatacagtgtctctcgaca

SEQ ID NO: 6244 - DNA, 57 bp, Artificial Sequence
  source: /note="Description of Artificial Sequence: Synthetic primer"
gggctggcaagccacgtttggtgagatctttcctctgagtcaacagtctccagaata

SEQ ID NO: 6245 - DNA, 58 bp, Artificial Sequence
  source: /note="Description of Artificial Sequence: Synthetic primer"
gggctggcaagccacgtttggtgcactgaaaaaggagatatctctgaggggtatcatg

SEQ ID NO: 6246 - DNA, 54 bp, Artificial Sequence
  source: /note="Description of Artificial Sequence: Synthetic primer"
gggctggcaagccacgtttggtggttcctgaagggtacaaagtctctcgaaaag

SEQ ID NO: 6247 - DNA, 50 bp, Artificial Sequence
  source: /note="Description of Artificial Sequence: Synthetic primer"
gggctggcaagccacgtttggtgctgaggggtacagtgtctctagagaga

SEQ ID NO: 6248 - DNA, 48 bp, Artificial Sequence
  source: /note="Description of Artificial Sequence: Synthetic primer"
gggctggcaagccacgtttggtgagccgcccaaacctaacattctcaa

SEQ ID NO: 6249 - DNA, 41 bp, Artificial Sequence
  source: /note="Description of Artificial Sequence: Synthetic primer"
gggctggcaagccacgtttggtgcccaggaccggcagttca

SEQ ID NO: 6250 - DNA, 63 bp, Artificial Sequence
  source: /note="Description of Artificial Sequence: Synthetic primer"
gggctggcaagccacgtttggtgttgattagagacatatccctattgaaaatatttcctggca

SEQ ID NO: 6251 - DNA, 54 bp, Artificial Sequence
  source: /note="Description of Artificial Sequence: Synthetic primer"
gggctggcaagccacgtttggtgagatgccctgagtcagcatagtcattctaac

SEQ ID NO: 6252 - DNA, 52 bp, Artificial Sequence
  source: /note="Description of Artificial Sequence: Synthetic primer"
ccgggagctgcatgtgtcagagggtcttacctacaactgtgagtctggtgcc

SEQ ID NO: 6253 - DNA, 51 bp, Artificial Sequence
  source: /note="Description of Artificial Sequence: Synthetic primer"
ccgggagctgcatgtgtcagaggccttacctacaacggttaacctggtccc

SEQ ID NO: 6254 - DNA, 54 bp, Artificial Sequence
  source: /note="Description of Artificial Sequence: Synthetic primer"
ccgggagctgcatgtgtcagaggcttactcacctacaacagtgagccaacttcc

SEQ ID NO: 6255 - DNA, 49 bp, Artificial Sequence
  source: /note="Description of Artificial Sequence: Synthetic primer"
ccgggagctgcatgtgtcagaggatacccaagacagagagctgggttcc

SEQ ID NO: 6256 - DNA, 52 bp, Artificial Sequence
  source: /note="Description of Artificial Sequence: Synthetic primer"
ccgggagctgcatgtgtcagaggaacttacctaggatggagagtcgagtccc

SEQ ID NO: 6257 - DNA, 45 bp, Artificial Sequence
  source: /note="Description of Artificial Sequence: Synthetic primer"
ccgggagctgcatgtgtcagaggctgtcacagtgagcctggtccc

SEQ ID NO: 6258 - DNA, 41 bp, Artificial Sequence
  source: /note="Description of Artificial Sequence: Synthetic primer"
ccgggagctgcatgtgtcagaggcacggtgagccgtgtccc

SEQ ID NO: 6259 - DNA, 45 bp, Artificial Sequence
  source: /note="Description of Artificial Sequence: Synthetic primer"
ccgggagctgcatgtgtcagaggccagtacggtcagcctagagcc

SEQ ID NO: 6260 - DNA, 41 bp, Artificial Sequence
  source: /note="Description of Artificial Sequence: Synthetic primer"
ccgggagctgcatgtgtcagaggcactgtcagccgggtgcc

SEQ ID NO: 6261 - DNA, 41 bp, Artificial Sequence
  source: /note="Description of Artificial Sequence: Synthetic primer"
ccgggagctgcatgtgtcagaggcactgagagccgggtccc

SEQ ID NO: 6262 - DNA, 40 bp, Artificial Sequence
  source: /note="Description of Artificial Sequence: Synthetic primer"
ccgggagctgcatgtgtcagaggaccaggagccgcgtgcc

SEQ ID NO: 6263 - DNA, 41 bp, Artificial Sequence
  source: /note="Description of Artificial Sequence: Synthetic primer"
ccgggagctgcatgtgtcagaggcacggtcagcctgctgcc

SEQ ID NO: 6264 - DNA, 41 bp, Artificial Sequence
  source: /note="Description of Artificial Sequence: Synthetic primer"
ccgggagctgcatgtgtcagagggaccgtgagcctggtgcc

SEQ ID NO: 6265 - DNA, 48 bp, Artificial Sequence
  source: /note="Description of Artificial Sequence: Synthetic primer"
gggctggcaagccacgtttggtgcgctagctggggctcacagtgctca

SEQ ID NO: 6266 - DNA, 50 bp, Artificial Sequence
  source: /note="Description of Artificial Sequence: Synthetic primer"
gggctggcaagccacgtttggtgcactgggctcagagtcctctcccacac

SEQ ID NO: 6267 - DNA, 59 bp, Artificial Sequence
  source: /note="Description of Artificial Sequence: Synthetic primer"
gggctggcaagccacgtttggtgcctatacagcactgggctcagagtcctctctgagac

SEQ ID NO: 6268 - DNA, 47 bp, Artificial Sequence
  source: /note="Description of Artificial Sequence: Synthetic primer"
gggctggcaagccacgtttggtgcctaagccaggggcagacccgagt

SEQ ID NO: 6269 - DNA, 59 bp, Artificial Sequence
  source: /note="Description of Artificial Sequence: Synthetic primer"
gggctggcaagccacgtttggtgacagtgtcacagagtccatcaaaaacccatgcctgg

SEQ ID NO: 6270 - DNA, 56 bp, Artificial Sequence
  source: /note="Description of Artificial Sequence: Synthetic primer"
gggctggcaagccacgtttggtgcactatccacataagcgagggacagacccgagt

SEQ ID NO: 6271 - DNA, 43 bp, Artificial Sequence
  source: /note="Description of Artificial Sequence: Synthetic primer"
gggctggcaagccacgtttggtgtgccctcgatggcaggcgga

SEQ ID NO: 6272 - DNA, 56 bp, Artificial Sequence
  source: /note="Description of Artificial Sequence: Synthetic primer"
gggctggcaagccacgtttggtgcctcttccaggacagtcctcagtggcatcacag

SEQ ID NO: 6273 - DNA, 48 bp, Artificial Sequence
  source: /note="Description of Artificial Sequence: Synthetic primer"
gggctggcaagccacgtttggtgcagacccacctgccctcaatggcag

SEQ ID NO: 6274 - DNA, 58 bp, Artificial Sequence
  source: /note="Description of Artificial Sequence: Synthetic primer"
gggctggcaagccacgtttggtgtctccagggagacactgtgcatgtctggtacctaa

SEQ ID NO: 6275 - DNA, 50 bp, Artificial Sequence
  source: /note="Description of Artificial Sequence: Synthetic primer"
gggctggcaagccacgtttggtggggacacagtgcatgtctggtccctga

SEQ ID NO: 6276 - DNA, 53 bp, Artificial Sequence
  source: /note="Description of Artificial Sequence: Synthetic primer"
gggctggcaagccacgtttggtgggacccctattccagacaccagacagaggc

SEQ ID NO: 6277 - DNA, 49 bp, Artificial Sequence
  source: /note="Description of Artificial Sequence: Synthetic primer"
gggctggcaagccacgtttggtgccccactccagacaccagacagaggg

SEQ ID NO: 6278 - DNA, 51 bp, Artificial Sequence
  source: /note="Description of Artificial Sequence: Synthetic primer"
gggctggcaagccacgtttggtgggggtctcccacgtgttttggggctaac

SEQ ID NO: 6279 - DNA, 47 bp, Artificial Sequence
  source: /note="Description of Artificial Sequence: Synthetic primer"
gggctggcaagccacgtttggtggctagctggggctgccagtcctca

SEQ ID NO: 6280 - DNA, 58 bp, Artificial Sequence
  source: /note="Description of Artificial Sequence: Synthetic primer"
gggctggcaagccacgtttggtgtctgcatctgtaggagacagagtcaccatcacttg

SEQ ID NO: 6281 - DNA, 58 bp, Artificial Sequence
  source: /note="Description of Artificial Sequence: Synthetic primer"
gggctggcaagccacgtttggtgtctgcatctacaggagacagagtcaccatcacttg

SEQ ID NO: 6282 - DNA, 58 bp, Artificial Sequence
  source: /note="Description of Artificial Sequence: Synthetic primer"
gggctggcaagccacgtttggtgctgcatctgtaaggagacagtgtcaccatcacttg

SEQ ID NO: 6283 - DNA, 58 bp, Artificial Sequence
  source: /note="Description of Artificial Sequence: Synthetic primer"
gggctggcaagccacgtttggtgtctgcatctacaggagacagagtcaccatcagttg

SEQ ID NO: 6284 - DNA, 58 bp, Artificial Sequence
  source: /note="Description of Artificial Sequence: Synthetic primer"
gggctggcaagccacgtttggtgactgcatctgtaggagagagagtcaccatcacttg

SEQ ID NO: 6285 - DNA, 56 bp, Artificial Sequence
  source: /note="Description of Artificial Sequence: Synthetic primer"
gggctggcaagccacgtttggtggcatctgtaaggagacagcgtcaccatcacttg

SEQ ID NO: 6286 - DNA, 59 bp, Artificial Sequence
  source: /note="Description of Artificial Sequence: Synthetic primer"
gggctggcaagccacgtttggtggtctgcatctgtaggagacagagtcagtatcatttg

SEQ ID NO: 6287 - DNA, 46 bp, Artificial Sequence
  source: /note="Description of Artificial Sequence: Synthetic primer"
gggctggcaagccacgtttggtgggagagccggcctccatctcctg

SEQ ID NO: 6288 - DNA, 49 bp, Artificial Sequence
  source: /note="Description of Artificial Sequence: Synthetic primer"
gggctggcaagccacgtttggtgcctggagagccagcctccatctcctg

SEQ ID NO: 6289 - DNA, 48 bp, Artificial Sequence
  source: /note="Description of Artificial Sequence: Synthetic primer"
gggctggcaagccacgtttggtgctggagagccggcctccatctcttg

SEQ ID NO: 6290 - DNA, 54 bp, Artificial Sequence
  source: /note="Description of Artificial Sequence: Synthetic primer"
gggctggcaagccacgtttggtgtcttccttggagagccatcctccatttcctg

SEQ ID NO: 6291 - DNA, 46 bp, Artificial Sequence
  source: /note="Description of Artificial Sequence: Synthetic primer"
gggctggcaagccacgtttggtgggacagccggcctccatctcctg

SEQ ID NO: 6292 - DNA, 47 bp, Artificial Sequence
  source: /note="Description of Artificial Sequence: Synthetic primer"
gggctggcaagccacgtttggtgtggagagccggcctccatctcctg

SEQ ID NO: 6293 - DNA, 59 bp, Artificial Sequence
  source: /note="Description of Artificial Sequence: Synthetic primer"
gggctggcaagccacgtttggtgataatatttgtacataactttgtacttcatctcctg

SEQ ID NO: 6294 - DNA, 51 bp, Artificial Sequence
  source: /note="Description of Artificial Sequence: Synthetic primer"
gggctggcaagccacgtttggtgcccctggaaagccagcctctatctcctg

SEQ ID NO: 6295 - DNA, 55 bp, Artificial Sequence
  source: /note="Description of Artificial Sequence: Synthetic primer"
gggctggcaagccacgtttggtgctcttccttggagagccatcctccatttcctg

SEQ ID NO: 6296 - DNA, 46 bp, Artificial Sequence
  source: /note="Description of Artificial Sequence: Synthetic primer"
gggctggcaagccacgtttggtgggacagccggcctccatctcctt

SEQ ID NO: 6297 - DNA, 49 bp, Artificial Sequence
  source: /note="Description of Artificial Sequence: Synthetic primer"
gggctggcaagccacgtttggtgcctggagagcaggcctccatgtcctg

SEQ ID NO: 6298 - DNA, 49 bp, Artificial Sequence
  source: /note="Description of Artificial Sequence: Synthetic primer"
gggctggcaagccacgtttggtgccaggggaaagagccaccctctcctg

SEQ ID NO: 6299 - DNA, 50 bp, Artificial Sequence
  source: /note="Description of Artificial Sequence: Synthetic primer"
gggctggcaagccacgtttggtgtccaggggaaagagtcaccctctcctg

SEQ ID NO: 6300 - DNA, 58 bp, Artificial Sequence
  source: /note="Description of Artificial Sequence: Synthetic primer"
gggctggcaagccacgtttggtgtctttgtctctggagaaaaaagccaccctgacttg

SEQ ID NO: 6301 - DNA, 52 bp, Artificial Sequence
  source: /note="Description of Artificial Sequence: Synthetic primer"
gggctggcaagccacgtttggtgtctctaggggaaaaagccaccctcaccta

SEQ ID NO: 6302 - DNA, 46 bp, Artificial Sequence
  source: /note="Description of Artificial Sequence: Synthetic primer"
gggctggcaagccacgtttggtgggggaaggagccaccctcacctg

SEQ ID NO: 6303 - DNA, 47 bp, Artificial Sequence
  source: /note="Description of Artificial Sequence: Synthetic primer"
gggctggcaagccacgtttggtggggcgagagggccaccatcaactg

SEQ ID NO: 6304 - DNA, 55 bp, Artificial Sequence
  source: /note="Description of Artificial Sequence: Synthetic primer"
gggctggcaagccacgtttggtggcgactccaggagacaaagtcaacatctcctg

SEQ ID NO: 6305 - DNA, 57 bp, Artificial Sequence
  source: /note="Description of Artificial Sequence: Synthetic primer"
gggctggcaagccacgtttggtgctgtgactccaaaggagaaagtcaccatcacctg

SEQ ID NO: 6306 - DNA, 52 bp, Artificial Sequence
  source: /note="Description of Artificial Sequence: Synthetic primer"
gggctggcaagccacgtttggtgactccaggggagaaagtcaccatcacctg

SEQ ID NO: 6307 - DNA, 48 bp, Artificial Sequence
  source: /note="Description of Artificial Sequence: Synthetic primer"
gggctggcaagccacgtttggtgcaggacagagggccaccatcacctg

SEQ ID NO: 6308 - DNA, 47 bp, Artificial Sequence
  source: /note="Description of Artificial Sequence: Synthetic primer"
gggctggcaagccacgtttggtggcaggacactcactcccccacctg

SEQ ID NO: 6309 - DNA, 48 bp, Artificial Sequence
  source: /note="Description of Artificial Sequence: Synthetic primer"
gggctggcaagccacgtttggtgtgggccagagggtcaccatctcctg

SEQ ID NO: 6310 - DNA, 46 bp, Artificial Sequence
  source: /note="Description of Artificial Sequence: Synthetic primer"
gggctggcaagccacgtttggtggggcaggtgggtaccagctcctg

SEQ ID NO: 6311 - DNA, 50 bp, Artificial Sequence
  source: /note="Description of Artificial Sequence: Synthetic primer"
gggctggcaagccacgtttggtgcgtgggacagaaggtcaccctctcctg

SEQ ID NO: 6312 - DNA, 52 bp, Artificial Sequence
  source: /note="Description of Artificial Sequence: Synthetic primer"
gggctggcaagccacgtttggtgtctctgggagcatcttccagactcacctg

SEQ ID NO: 6313 - DNA, 50 bp, Artificial Sequence
  source: /note="Description of Artificial Sequence: Synthetic primer"
gggctggcaagccacgtttggtgcacctccggatcagccagactctcctg

SEQ ID NO: 6314 - DNA, 49 bp, Artificial Sequence
  source: /note="Description of Artificial Sequence: Synthetic primer"
gggctggcaagccacgtttggtgccgggagcatgagccagacttacctg

SEQ ID NO: 6315 - DNA, 59 bp, Artificial Sequence
  source: /note="Description of Artificial Sequence: Synthetic primer"
gggctggcaagccacgtttggtgctctgcacatctgagaaatgctataagacttccctg

SEQ ID NO: 6316 - DNA, 50 bp, Artificial Sequence
  source: /note="Description of Artificial Sequence: Synthetic primer"
gggctggcaagccacgtttggtgtgtgggagcctcggtcaagcttacctc

SEQ ID NO: 6317 - DNA, 49 bp, Artificial Sequence
  source: /note="Description of Artificial Sequence: Synthetic primer"
gggctggcaagccacgtttggtgcccaggcagagggtcaccatctcctg

SEQ ID NO: 6318 - DNA, 49 bp, Artificial Sequence
  source: /note="Description of Artificial Sequence: Synthetic primer"
gggctggcaagccacgtttggtgccagggcagagggtcaccatctcctg

SEQ ID NO: 6319 - DNA, 48 bp, Artificial Sequence
  source: /note="Description of Artificial Sequence: Synthetic primer"
gggctggcaagccacgtttggtgccgggcagagggtcaccatctcttg

SEQ ID NO: 6320 - DNA, 51 bp, Artificial Sequence
  source: /note="Description of Artificial Sequence: Synthetic primer"
gggctggcaagccacgtttggtgccccaggacagaaggtcaccatctcctg

SEQ ID NO: 6321 - DNA, 51 bp, Artificial Sequence
  source: /note="Description of Artificial Sequence: Synthetic primer"
gggctggcaagccacgtttggtgccacaaggcagaggctcactgtctcctg

SEQ ID NO: 6322 - DNA, 53 bp, Artificial Sequence
  source: /note="Description of Artificial Sequence: Synthetic primer"
gggctggcaagccacgtttggtggtctcctggacagtcagtcaccatctcctg

SEQ ID NO: 6323 - DNA, 53 bp, Artificial Sequence
  source: /note="Description of Artificial Sequence: Synthetic primer"
gggctggcaagccacgtttggtggtctcctggacagtcgatcaccatctcctg

SEQ ID NO: 6324 - DNA, 50 bp, Artificial Sequence
  source: /note="Description of Artificial Sequence: Synthetic primer"
gggctggcaagccacgtttggtgtcctggacagtcggtcaccatctcctg

SEQ ID NO: 6325 - DNA, 56 bp, Artificial Sequence
  source: /note="Description of Artificial Sequence: Synthetic primer"
gggctggcaagccacgtttggtgctgggacttggggtaaacagtcaccatcttctg

SEQ ID NO: 6326 - DNA, 49 bp, Artificial Sequence
  source: /note="Description of Artificial Sequence: Synthetic primer"
gggctggcaagccacgtttggtgccaggacagacagccagcatcacctg

SEQ ID NO: 6327 - DNA, 51 bp, Artificial Sequence
  source: /note="Description of Artificial Sequence: Synthetic primer"
gggctggcaagccacgtttggtgctttgggacgtacggccaggatcatctg

SEQ ID NO: 6328 - DNA, 51 bp, Artificial Sequence
  source: /note="Description of Artificial Sequence: Synthetic primer"
gggctggcaagccacgtttggtgctttgggacagatggccaggatcacctg

SEQ ID NO: 6329 - DNA, 49 bp, Artificial Sequence
  source: /note="Description of Artificial Sequence: Synthetic primer"
gggctggcaagccacgtttggtgccaggacaggcagccatgatcacctg

SEQ ID NO: 6330 - DNA, 48 bp, Artificial Sequence
  source: /note="Description of Artificial Sequence: Synthetic primer"
gggctggcaagccacgtttggtgtgggacagagggccaggatcaccta

SEQ ID NO: 6331 - DNA, 47 bp, Artificial Sequence
  source: /note="Description of Artificial Sequence: Synthetic primer"
gggctggcaagccacgtttggtggggacaggcggccaggattacctg

SEQ ID NO: 6332 - DNA, 49 bp, Artificial Sequence
  source: /note="Description of Artificial Sequence: Synthetic primer"
gggctggcaagccacgtttggtgccaggacaaacggccaggatcacctg

SEQ ID NO: 6333 - DNA, 50 bp, Artificial Sequence
  source: /note="Description of Artificial Sequence: Synthetic primer"
gggctggcaagccacgtttggtgcacagcacagatggccaggatcacctg

SEQ ID NO: 6334 - DNA, 49 bp, Artificial Sequence
  source: /note="Description of Artificial Sequence: Synthetic primer"
gggctggcaagccacgtttggtgccaggacagacagccaggatcagctg

SEQ ID NO: 6335 - DNA, 51 bp, Artificial Sequence
  source: /note="Description of Artificial Sequence: Synthetic primer"
gggctggcaagccacgtttggtgccccaggacagatgaccaggatcacctg

SEQ ID NO: 6336 - DNA, 51 bp, Artificial Sequence
  source: /note="Description of Artificial Sequence: Synthetic primer"
gggctggcaagccacgtttggtgccctaggacagatggccaggatcacctg

SEQ ID NO: 6337 - DNA, 54 bp, Artificial Sequence
  source: /note="Description of Artificial Sequence: Synthetic primer"
gggctggcaagccacgtttggtggtgtctgtggacagtcagcaagggtaacctg

SEQ ID NO: 6338 - DNA, 53 bp, Artificial Sequence
  source: /note="Description of Artificial Sequence: Synthetic primer"
gggctggcaagccacgtttggtgggccttgggacagacagtcaggatcacatg

SEQ ID NO: 6339 - DNA, 51 bp, Artificial Sequence
  source: /note="Description of Artificial Sequence: Synthetic primer"
gggctggcaagccacgtttggtgccccaggaaagacggccaggattacctg

SEQ ID NO: 6340 - DNA, 50 bp, Artificial Sequence
  source: /note="Description of Artificial Sequence: Synthetic primer"
gggctggcaagccacgtttggtgcccaggacagaaagccaggatcacctg

SEQ ID NO: 6341 - DNA, 57 bp, Artificial Sequence
  source: /note="Description of Artificial Sequence: Synthetic primer"
gggctggcaagccacgtttggtgcagtagctccaggacagatgactaggatcacctg

SEQ ID NO: 6342 - DNA, 48 bp, Artificial Sequence
  source: /note="Description of Artificial Sequence: Synthetic primer"
gggctggcaagccacgtttggtgcaggacagacggccaggatcacctg

SEQ ID NO: 6343 - DNA, 50 bp, Artificial Sequence
  source: /note="Description of Artificial Sequence: Synthetic primer"
gggctggcaagccacgtttggtgcctgggacagtcagccagggtaacctg

SEQ ID NO: 6344 - DNA, 48 bp, Artificial Sequence
  source: /note="Description of Artificial Sequence: Synthetic primer"
gggctggcaagccacgtttggtgcgggacagacagccaggatcacctg

SEQ ID NO: 6345 - DNA, 50 bp, Artificial Sequence
  source: /note="Description of Artificial Sequence: Synthetic primer"
gggctggcaagccacgtttggtgcccaggacagacacccaggatcacctg

SEQ ID NO: 6346 - DNA, 51 bp, Artificial Sequence
  source: /note="Description of Artificial Sequence: Synthetic primer"
gggctggcaagccacgtttggtgccccattacagatggccaggatcacctg

SEQ ID NO: 6347 - DNA, 52 bp, Artificial Sequence
  source: /note="Description of Artificial Sequence: Synthetic primer"
gggctggcaagccacgtttggtggccttgggatagacagccaggatcacctg

SEQ ID NO: 6348 - DNA, 51 bp, Artificial Sequence
  source: /note="Description of Artificial Sequence: Synthetic primer"
gggctggcaagccacgtttggtgccttgggacaaatggccaggatcacctg

SEQ ID NO: 6349 - DNA, 49 bp, Artificial Sequence
  source: /note="Description of Artificial Sequence: Synthetic primer"
gggctggcaagccacgtttggtgctgggagcctcgatcaagctcacctg

SEQ ID NO: 6350 - DNA, 50 bp, Artificial Sequence
  source: /note="Description of Artificial Sequence: Synthetic primer"
gggctggcaagccacgtttggtgcctgggatcctcggtcaagctcacctg

SEQ ID NO: 6351 - DNA, 47 bp, Artificial Sequence
  source: /note="Description of Artificial Sequence: Synthetic primer"
gggctggcaagccacgtttggtggggagcctcggtcaagctcacctg

SEQ ID NO: 6352 - DNA, 50 bp, Artificial Sequence
  source: /note="Description of Artificial Sequence: Synthetic primer"
gggctggcaagccacgtttggtgtcctggagaatccgccagactcacctg

SEQ ID NO: 6353 - DNA, 52 bp, Artificial Sequence
  source: /note="Description of Artificial Sequence: Synthetic primer"
gggctggcaagccacgtttggtgtctcctggagcatcagccagattcacctg

SEQ ID NO: 6354 - DNA, 50 bp, Artificial Sequence
  source: /note="Description of Artificial Sequence: Synthetic primer"
gggctggcaagccacgtttggtgtcctggagcatcagccagtctcacctg

SEQ ID NO: 6355 - DNA, 50 bp, Artificial Sequence
  source: /note="Description of Artificial Sequence: Synthetic primer"
gggctggcaagccacgtttggtgtcctggagcatcagccagactcacctg

SEQ ID NO: 6356 - DNA, 55 bp, Artificial Sequence
  source: /note="Description of Artificial Sequence: Synthetic primer"
gggctggcaagccacgtttggtggcatcttctggagcatcagtcagactcacctg

SEQ ID NO: 6357 - DNA, 50 bp, Artificial Sequence
  source: /note="Description of Artificial Sequence: Synthetic primer"
gggctggcaagccacgtttggtgtccggggaagacggtaaccatctcctg

SEQ ID NO: 6358 - DNA, 50 bp, Artificial Sequence
  source: /note="Description of Artificial Sequence: Synthetic primer"
gggctggcaagccacgtttggtgcccaggagggacagtcactctcaccta

SEQ ID NO: 6359 - DNA, 50 bp, Artificial Sequence
  source: /note="Description of Artificial Sequence: Synthetic primer"
gggctggcaagccacgtttggtgcccaggagggacagtcactctcacctg

SEQ ID NO: 6360 - DNA, 51 bp, Artificial Sequence
  source: /note="Description of Artificial Sequence: Synthetic primer"
gggctggcaagccacgtttggtgcccctggagggacagtcacactcacttg

SEQ ID NO: 6361 - DNA, 48 bp, Artificial Sequence
  source: /note="Description of Artificial Sequence: Synthetic primer"
gggctggcaagccacgtttggtgtgggagcctcggtcacactcacctg

SEQ ID NO: 6362 - DNA, 50 bp, Artificial Sequence
  source: /note="Description of Artificial Sequence: Synthetic primer"
gggctggcaagccacgtttggtgcttgagacagaccgccacactcacctg

SEQ ID NO: 6363 - DNA, 55 bp, Artificial Sequence
  source: /note="Description of Artificial Sequence: Synthetic primer"
ccgggagctgcatgtgtcagaggttctactcacgtttgatttccaccttggtccc

SEQ ID NO: 6364 - DNA, 55 bp, Artificial Sequence
  source: /note="Description of Artificial Sequence: Synthetic primer"
ccgggagctgcatgtgtcagaggaagtacttacgtttgatctccagcttggtccc

SEQ ID NO: 6365 - DNA, 59 bp, Artificial Sequence
  source: /note="Description of Artificial Sequence: Synthetic primer"
ccgggagctgcatgtgtcagaggacagatgtacttacgtttgatatccactttggtccc

SEQ ID NO: 6366 - DNA, 52 bp, Artificial Sequence
  source: /note="Description of Artificial Sequence: Synthetic primer"
ccgggagctgcatgtgtcagaggcacttacgtttgatctccaccttggtccc

SEQ ID NO: 6367 - DNA, 59 bp, Artificial Sequence
  source: /note="Description of Artificial Sequence: Synthetic primer"
ccgggagctgcatgtgtcagagggaaaaattacttacgtttaatctccagtcgtgtccc

SEQ ID NO: 6368 - DNA, 50 bp, Artificial Sequence
  source: /note="Description of Artificial Sequence: Synthetic primer"
ccgggagctgcatgtgtcagaggcttacctaggacggtgaccttggtccc

SEQ ID NO: 6369 - DNA, 47 bp, Artificial Sequence
  source: /note="Description of Artificial Sequence: Synthetic primer"
ccgggagctgcatgtgtcagaggacctaggacggtcagcttggtccc

SEQ ID NO: 6370 - DNA, 59 bp, Artificial Sequence
  source: /note="Description of Artificial Sequence: Synthetic primer"
ccgggagctgcatgtgtcagaggaagaagagactcatctaaaatgatcagctgggttcc

SEQ ID NO: 6371 - DNA, 47 bp, Artificial Sequence
  source: /note="Description of Artificial Sequence: Synthetic primer"
ccgggagctgcatgtgtcagaggatctaggacggtcagctccgtccc

SEQ ID NO: 6372 - DNA, 44 bp, Artificial Sequence
  source: /note="Description of Artificial Sequence: Synthetic primer"
ccgggagctgcatgtgtcagagggaggacggtcaccttggtgcc

SEQ ID NO: 6373 - DNA, 43 bp, Artificial Sequence
  source: /note="Description of Artificial Sequence: Synthetic primer"
ccgggagctgcatgtgtcagaggaggacggtcagctgggtgcc

SEQ ID NO: 6374 - DNA, 47 bp, Artificial Sequence
  source: /note="Description of Artificial Sequence: Synthetic primer"
ccgggagctgcatgtgtcagaggctgcagactcatgaggagtcgccc

SEQ ID NO: 6375 - DNA, 8 bp, Artificial Sequence
  source: /note="Description of Artificial Sequence: Synthetic oligonucleotide"
caaggtca

SEQ ID NO: 6376 - DNA, 8 bp, Artificial Sequence
  source: /note="Description of Artificial Sequence: Synthetic oligonucleotide"
tacgtacg

SEQ ID NO: 6377 - DNA, 8 bp, Artificial Sequence
  source: /note="Description of Artificial Sequence: Synthetic oligonucleotide"
tacgcgtt

SEQ ID NO: 6378 - DNA, 8 bp, Artificial Sequence
  source: /note="Description of Artificial Sequence: Synthetic oligonucleotide"
ctcagtga

SEQ ID NO: 6379 - DNA, 8 bp, Artificial Sequence
  source: /note="Description of Artificial Sequence: Synthetic oligonucleotide"
gtgtctac

SEQ ID NO: 6380 - DNA, 8 bp, Artificial Sequence
  source: /note="Description of Artificial Sequence: Synthetic oligonucleotide"
agtaccga

SEQ ID NO: 6381 - DNA, 8 bp, Artificial Sequence
  source: /note="Description of Artificial Sequence: Synthetic oligonucleotide"
ttgcctca

SEQ ID NO: 6382 - DNA, 8 bp, Artificial Sequence
  source: /note="Description of Artificial Sequence: Synthetic oligonucleotide"
tcgttagc

SEQ ID NO: 6383 - DNA, 8 bp, Artificial Sequence
  source: /note="Description of Artificial Sequence: Synthetic oligonucleotide"
tggacatg

SEQ ID NO: 6384 - DNA, 8 bp, Artificial Sequence
  source: /note="Description of Artificial Sequence: Synthetic oligonucleotide"
aggttgct

SEQ ID NO: 6385 - DNA, 8 bp, Artificial Sequence
  source: /note="Description of Artificial Sequence: Synthetic oligonucleotide"
gtacagtg

SEQ ID NO: 6386 - DNA, 8 bp, Artificial Sequence
  source: /note="Description of Artificial Sequence: Synthetic oligonucleotide"
atccatgg

SEQ ID NO: 6387 - DNA, 8 bp, Artificial Sequence
  source: /note="Description of Artificial Sequence: Synthetic oligonucleotide"
tgatgcga

SEQ ID NO: 6388 - DNA, 8 bp, Artificial Sequence
  source: /note="Description of Artificial Sequence: Synthetic oligonucleotide"
gtagcagt

SEQ ID NO: 6389 - DNA, 8 bp, Artificial Sequence
  source: /note="Description of Artificial Sequence: Synthetic oligonucleotide"
ggatcatc

SEQ ID NO: 6390 - DNA, 8 bp, Artificial Sequence
  source: /note="Description of Artificial Sequence: Synthetic oligonucleotide"
gtgaacgt

SEQ ID NO: 6391 - DNA, 8 bp, Artificial Sequence
  source: /note="Description of Artificial Sequence: Synthetic oligonucleotide"
tgtcatcg

SEQ ID NO: 6392 - DNA, 8 bp, Artificial Sequence
  source: /note="Description of Artificial Sequence: Synthetic oligonucleotide"
aggcttga

SEQ ID NO: 6393 - DNA, 8 bp, Artificial Sequence
  source: /note="Description of Artificial Sequence: Synthetic oligonucleotide"
acacacgt

SEQ ID NO: 6394 - DNA, 8 bp, Artificial Sequence
  source: /note="Description of Artificial Sequence: Synthetic oligonucleotide"
tccacagt

SEQ ID NO: 6395 - DNA, 8 bp, Artificial Sequence
  source: /note="Description of Artificial Sequence: Synthetic oligonucleotide"
cagtctgt

SEQ ID NO: 6396 - DNA, 8 bp, Artificial Sequence
  source: /note="Description of Artificial Sequence: Synthetic oligonucleotide"
tccatgtg

SEQ ID NO: 6397 - DNA, 8 bp, Artificial Sequence
  source: /note="Description of Artificial Sequence: Synthetic oligonucleotide"
tcactgca

SEQ ID NO: 6398 - DNA, 8 bp, Artificial Sequence
  source: /note="Description of Artificial Sequence: Synthetic oligonucleotide"
caagtcac

SEQ ID NO: 6399 - DNA, 8 bp, Artificial Sequence
  source: /note="Description of Artificial Sequence: Synthetic oligonucleotide"
tagacgga

SEQ ID NO: 6400 - DNA, 8 bp, Artificial Sequence
  source: /note="Description of Artificial Sequence: Synthetic oligonucleotide"
gagcgata

SEQ ID NO: 6401 - DNA, 8 bp, Artificial Sequence
  source: /note="Description of Artificial Sequence: Synthetic oligonucleotide"
ctcgagaa

SEQ ID NO: 6402 - DNA, 8 bp, Artificial Sequence
  source: /note="Description of Artificial Sequence: Synthetic oligonucleotide"
atgacacc

SEQ ID NO: 6403 - DNA, 8 bp, Artificial Sequence
  source: /note="Description of Artificial Sequence: Synthetic oligonucleotide"
cttcacga

SEQ ID NO: 6404 - DNA, 8 bp, Artificial Sequence
  source: /note="Description of Artificial Sequence: Synthetic oligonucleotide"
cgtagagt

SEQ ID NO: 6405 - DNA, 8 bp, Artificial Sequence
  source: /note="Description of Artificial Sequence: Synthetic oligonucleotide"
tcgtcgat

SEQ ID NO: 6406 - DNA, 8 bp, Artificial Sequence
  source: /note="Description of Artificial Sequence: Synthetic oligonucleotide"
agctagtg

SEQ ID NO: 6407 - DNA, 8 bp, Artificial Sequence
  source: /note="Description of Artificial Sequence: Synthetic oligonucleotide"
tgagacct

SEQ ID NO: 6408 - DNA, 8 bp, Artificial Sequence
  source: /note="Description of Artificial Sequence: Synthetic oligonucleotide"
gatggctt

SEQ ID NO: 6409 - DNA, 8 bp, Artificial Sequence
  source: /note="Description of Artificial Sequence: Synthetic oligonucleotide"
gcatctga

SEQ ID NO: 6410 - DNA, 8 bp, Artificial Sequence
  source: /note="Description of Artificial Sequence: Synthetic oligonucleotide"
gacactct

SEQ ID NO: 6411 - DNA, 8 bp, Artificial Sequence
  source: /note="Description of Artificial Sequence: Synthetic oligonucleotide"
tgctacac

SEQ ID NO: 6412 - DNA, 8 bp, Artificial Sequence
  source: /note="Description of Artificial Sequence: Synthetic oligonucleotide"
tcagcttg

SEQ ID NO: 6413 - DNA, 8 bp, Artificial Sequence
  source: /note="Description of Artificial Sequence: Synthetic oligonucleotide"
ttcggaac

SEQ ID NO: 6414 - DNA, 8 bp, Artificial Sequence
  source: /note="Description of Artificial Sequence: Synthetic oligonucleotide"
gcaattcg

SEQ ID NO: 6415 - DNA, 8 bp, Artificial Sequence
  source: /note="Description of Artificial Sequence: Synthetic oligonucleotide"
caagaggt

SEQ ID NO: 6416 - DNA, 8 bp, Artificial Sequence
  source: /note="Description of Artificial Sequence: Synthetic oligonucleotide"
gaatggac

SEQ ID NO: 6417 - DNA, 8 bp, Artificial Sequence
  source: /note="Description of Artificial Sequence: Synthetic oligonucleotide"
aactgcca

SEQ ID NO: 6418 - DNA, 8 bp, Artificial Sequence
  source: /note="Description of Artificial Sequence: Synthetic oligonucleotide"
cctagtag

SEQ ID NO: 6419 - DNA, 8 bp, Artificial Sequence
  source: /note="Description of Artificial Sequence: Synthetic oligonucleotide"
ctgacgtt

SEQ ID NO: 6420 - DNA, 8 bp, Artificial Sequence
  source: /note="Description of Artificial Sequence: Synthetic oligonucleotide"
tgcagaca

SEQ ID NO: 6421 - DNA, 8 bp, Artificial Sequence
  source: /note="Description of Artificial Sequence: Synthetic oligonucleotide"
agttgacc

SEQ ID NO: 6422 - DNA, 8 bp, Artificial Sequence
  source: /note="Description of Artificial Sequence: Synthetic oligonucleotide"
gtctccta

SEQ ID NO: 6423 - DNA, 8 bp, Artificial Sequence
  source: /note="Description of Artificial Sequence: Synthetic oligonucleotide"
ctgcaatc

SEQ ID NO: 6424 - DNA, 8 bp, Artificial Sequence
  source: /note="Description of Artificial Sequence: Synthetic oligonucleotide"
tgagcgaa

SEQ ID NO: 6425 - DNA, 8 bp, Artificial Sequence
  source: /note="Description of Artificial Sequence: Synthetic oligonucleotide"
ttggactg

SEQ ID NO: 6426 - DNA, 8 bp, Artificial Sequence
  source: /note="Description of Artificial Sequence: Synthetic oligonucleotide"
agcaatcc

SEQ ID NO: 6427 - DNA, 8 bp, Artificial Sequence
  source: /note="Description of Artificial Sequence: Synthetic oligonucleotide"
cgaactac

SEQ ID NO: 6428 - DNA, 23 bp, Artificial Sequence
  source: /note="Description of Artificial Sequence: Synthetic primer"
gggctggcaagccacgtttggtg

SEQ ID NO: 6429 - DNA, 23 bp, Artificial Sequence
  source: /note="Description of Artificial Sequence: Synthetic primer"
ccgggagctgcatgtgtcagagg

SEQ ID NO: 6430 - DNA, 49 bp, Artificial Sequence; identical to SEQ ID NO: 5201
  source: /note="Description of Artificial Sequence: Synthetic primer"

SEQ ID NO: 6431 - DNA, 48 bp, Artificial Sequence; identical to SEQ ID NO: 5287
  source: /note="Description of Artificial Sequence: Synthetic primer"

SEQ ID NO: 6432 - DNA, 49 bp, Artificial Sequence; identical to SEQ ID NO: 5201
  source: /note="Description of Artificial Sequence: Synthetic primer"

SEQ ID NO: 6433 - DNA, 48 bp, Artificial Sequence; identical to SEQ ID NO: 5287
  source: /note="Description of Artificial Sequence: Synthetic primer"

SEQ ID NO: 6434 - DNA, 26 bp, Artificial Sequence
  source: /note="Description of Artificial Sequence: Synthetic primer"
gaatgccctgacagctctcgcttata

SEQ ID NO: 6435 - DNA, 41 bp, Artificial Sequence
  source: /note="Description of Artificial Sequence: Synthetic primer"
ctcagagaagtctgaaatattcgatgatcaattctcagttg

SEQ ID NO: 6436 - DNA, 34 bp, Artificial Sequence
  source: /note="Description of Artificial Sequence: Synthetic primer"
ccaaatcgmttctcacctaaatctccagacaaag

SEQ ID NO: 6437 - DNA, 26 bp, Artificial Sequence
  source: /note="Description of Artificial Sequence: Synthetic primer"
cacctgactctccagacaaagctcat

SEQ ID NO: 6438 - DNA, 22 bp, Artificial Sequence
  source: /note="Description of Artificial Sequence: Synthetic primer"
cctgaatgccccaacagctctc

SEQ ID NO: 6439 - DNA, 24 bp, Artificial Sequence
  source: /note="Description of Artificial Sequence: Synthetic primer"
gattctcagggcgccagttctcta

SEQ ID NO: 6440 - DNA, 31 bp, Artificial Sequence
  source: /note="Description of Artificial Sequence: Synthetic primer"
cctaattgattctcagctcaccacgtccata

SEQ ID NO: 6441 - DNA, 19 bp, Artificial Sequence
  source: /note="Description of Artificial Sequence: Synthetic primer"
tcagggcgccagttccatg

SEQ ID NO: 6442 - DNA, 29 bp, Artificial Sequence
  source: /note="Description of Artificial Sequence: Synthetic primer"
tcctagattctcaggtctccagttcccta

SEQ ID NO: 6443 - DNA, 28 bp, Artificial Sequence
  source: /note="Description of Artificial Sequence: Synthetic primer"
gaggaaacttccctgatcgattctcagc

SEQ ID NO: 6444 - DNA, 27 bp, Artificial Sequence
  source: /note="Description of Artificial Sequence: Synthetic primer"
caacttccctgatcgattctcaggtca

SEQ ID NO: 6445 - DNA, 30 bp, Artificial Sequence
  source: /note="Description of Artificial Sequence: Synthetic primer"
aggaaacttccctgatcaattctcaggtca

SEQ ID NO: 6446 - DNA, 29 bp, Artificial Sequence
  source: /note="Description of Artificial Sequence: Synthetic primer"
ggaaacttccctcctagattttcaggtcg

SEQ ID NO: 6447 - DNA, 27 bp, Artificial Sequence
  source: /note="Description of Artificial Sequence: Synthetic primer"
ccccaatggctacaatgtctccagatt

SEQ ID NO: 6448 - DNA, 23 bp, Artificial Sequence
  source: /note="Description of Artificial Sequence: Synthetic primer"
ggagaggtccctgatggctacaa

SEQ ID NO: 6449 - DNA, 28 bp, Artificial Sequence
  source: /note="Description of Artificial Sequence: Synthetic primer"
tccctgatggttatagtgtctccagagc

SEQ ID NO: 6450 - DNA, 27 bp, Artificial Sequence
  source: /note="Description of Artificial Sequence: Synthetic primer"
ggagaagtccccaatggctacaatgtc

SEQ ID NO: 6451 - DNA, 26 bp, Artificial Sequence
  source: /note="Description of Artificial Sequence: Synthetic primer"
aaaggagaagtcccgaatggctacaa

SEQ ID NO: 6452 - DNA, 29 bp, Artificial Sequence
  source: /note="Description of Artificial Sequence: Synthetic primer"
gttcccaatggctacaatgtctccagatc

SEQ ID NO: 6453 - DNA, 32 bp, Artificial Sequence
  source: /note="Description of Artificial Sequence: Synthetic primer"
gaagtccccaatggctacaatgtctctagatt

SEQ ID NO: 6454 - DNA, 26 bp, Artificial Sequence
  source: /note="Description of Artificial Sequence: Synthetic primer"
gagaagtccccgatggctacaatgta

SEQ ID NO: 6455 - DNA, 24 bp, Artificial Sequence
  source: /note="Description of Artificial Sequence: Synthetic primer"
gtgatcggttctctgcacagaggt

SEQ ID NO: 6456 - DNA, 23 bp, Artificial Sequence
  source: /note="Description of Artificial Sequence: Synthetic primer"
cgcttctctgcagagaggactgg

SEQ ID NO: 6457 - DNA, 22 bp, Artificial Sequence
  source: /note="Description of Artificial Sequence: Synthetic primer"
ggttctttgcagtcaggcctga

SEQ ID NO: 6458 - DNA, 22 bp, Artificial Sequence
  source: /note="Description of Artificial Sequence: Synthetic primer"
cagtggtcggttctctgcagag

SEQ ID NO: 6459 - DNA, 29 bp, Artificial Sequence
  source: /note="Description of Artificial Sequence: Synthetic primer"
gctcagtgatcaattctccacagagaggt

SEQ ID NO: 6460 - DNA, 22 bp, Artificial Sequence
  source: /note="Description of Artificial Sequence: Synthetic primer"
ttctctgcagagaggcctgagg

SEQ ID NO: 6461 - DNA, 25 bp, Artificial Sequence
  source: /note="Description of Artificial Sequence: Synthetic primer"
cccagtgatcgcttctttgcagaaa

SEQ ID NO: 6462 - DNA, 23 bp, Artificial Sequence
  source: /note="Description of Artificial Sequence: Synthetic primer"
ctgcagagaggcctaagggatct

SEQ ID NO: 6463 - DNA, 33 bp, Artificial Sequence
  source: /note="Description of Artificial Sequence: Synthetic primer"
gaagggtacaatgtctctggaaacaaactcaag

SEQ ID NO: 6464 - DNA, 31 bp, Artificial Sequence
  source: /note="Description of Artificial Sequence: Synthetic primer"
ggggtactgtgtttcttgaaacaagcttgag

SEQ ID NO: 6465 - DNA, 30 bp, Artificial Sequence
  source: /note="Description of Artificial Sequence: Synthetic primer"
cagttccctgacttgcactctgaactaaac

SEQ ID NO: 6466 - DNA, 32 bp, Artificial Sequence
  source: /note="Description of Artificial Sequence: Synthetic primer"
actaacaaaggagaagtctcagatggctacag

SEQ ID NO: 6467 - DNA, 27 bp, Artificial Sequence
  source: /note="Description of Artificial Sequence: Synthetic primer"
agataaaggagaagtccccgatggcta

SEQ ID NO: 6468 - DNA, 35 bp, Artificial Sequence
  source: /note="Description of Artificial Sequence: Synthetic primer"
gatactgacaaaggagaagtctcagatggctatag

SEQ ID NO: 6469 - DNA, 29 bp, Artificial Sequence
  source: /note="Description of Artificial Sequence: Synthetic primer"
ctaaggatcgattttctgcagagaggctc

SEQ ID NO: 6470 - DNA, 27 bp, Artificial Sequence
  source: /note="Description of Artificial Sequence: Synthetic primer"
ttgattctcagcacagatgcctgatgt

SEQ ID NO: 6471 - DNA, 24 bp, Artificial Sequence
  source: /note="Description of Artificial Sequence: Synthetic primer"
attctcagctgagaggcctgatgg

SEQ ID NO: 6472 - DNA, 30 bp, Artificial Sequence
  source: /note="Description of Artificial Sequence: Synthetic primer"
ggatcgattctcagctaagatgcctaatgc

SEQ ID NO: 6473 - DNA, 28 bp, Artificial Sequence
  source: /note="Description of Artificial Sequence: Synthetic primer"
ctcagcagagatgcctgatgcaacttta

SEQ ID NO: 6474 - DNA, 29 bp, Artificial Sequence
  source: /note="Description of Artificial Sequence: Synthetic primer"
ctgatcgattctcagctcaacagttcagt

SEQ ID NO: 6475 - DNA, 26 bp, Artificial Sequence
  source: /note="Description of Artificial Sequence: Synthetic primer"
tagctgaaaggactggagggacgtat

SEQ ID NO: 6476 - DNA, 24 bp, Artificial Sequence
  source: /note="Description of Artificial Sequence: Synthetic primer"
ccaggaggccgaacacttctttct

SEQ ID NO: 6477 - DNA, 25 bp, Artificial Sequence
  source: /note="Description of Artificial Sequence: Synthetic primer"
gctaagtgcctcccaaattcaccct

SEQ ID NO: 6478 - DNA, 26 bp, Artificial Sequence
  source: /note="Description of Artificial Sequence: Synthetic primer"
cacagctgaaagacctaacggaacgt

SEQ ID NO: 6479 - DNA, 24 bp, Artificial Sequence
  source: /note="Description of Artificial Sequence: Synthetic primer"
ctgctgaatttcccaaagagggcc

SEQ ID NO: 6480 - DNA, 20 bp, Artificial Sequence
  source: /note="Description of Artificial Sequence: Synthetic primer"
agggtacagcgtctctcggg

SEQ ID NO: 6481 - DNA, 23 bp, Artificial Sequence
  source: /note="Description of Artificial Sequence: Synthetic primer"
gcctgaccttgtccactctgaca

SEQ ID NO: 6482 - DNA, 27 bp, Artificial Sequence
  source: /note="Description of Artificial Sequence: Synthetic primer"
atgagcgatttttagcccaatgctcca

SEQ ID NO: 6483 - DNA, 24 bp, Artificial Sequence
  source: /note="Description of Artificial Sequence: Synthetic primer"
tgaaggctacgtgtctgccaagag

SEQ ID NO: 6484 - DNA, 24 bp, Artificial Sequence
  source: /note="Description of Artificial Sequence: Synthetic primer"
ctcatctcaatgccccaagaacgc

SEQ ID NO: 6485 - DNA, 31 bp, Artificial Sequence
  source: /note="Description of Artificial Sequence: Synthetic primer"
agatctctgatggatacagtgtctctcgaca

SEQ ID NO: 6486 - DNA, 34 bp, Artificial Sequence
  source: /note="Description of Artificial Sequence: Synthetic primer"
agatctttcctctgagtcaacagtctccagaata

SEQ ID NO: 6487 - DNA, 35 bp, Artificial Sequence
  source: /note="Description of Artificial Sequence: Synthetic primer"
cactgaaaaaggagatatctctgaggggtatcatg

SEQ ID NO: 6488 - DNA, 31 bp, Artificial Sequence
  source: /note="Description of Artificial Sequence: Synthetic primer"
gttcctgaagggtacaaagtctctcgaaaag

SEQ ID NO: 6489 - DNA, 27 bp, Artificial Sequence
  source: /note="Description of Artificial Sequence: Synthetic primer"
ctgaggggtacagtgtctctagagaga

SEQ ID NO: 6490 - DNA, 25 bp, Artificial Sequence
  source: /note="Description of Artificial Sequence: Synthetic primer"
agccgcccaaacctaacattctcaa

SEQ ID NO: 6491 - DNA, 18 bp, Artificial Sequence
  source: /note="Description of Artificial Sequence: Synthetic primer"
cccaggaccggcagttca

SEQ ID NO: 6492 - DNA, 40 bp, Artificial Sequence
  source: /note="Description of Artificial Sequence: Synthetic primer"
ttgattagagacatatccctattgaaaatatttcctggca

SEQ ID NO: 6493 - DNA, 31 bp, Artificial Sequence
  source: /note="Description of Artificial Sequence: Synthetic primer"
agatgccctgagtcagcatagtcattctaac

SEQ ID NO: 6494 - DNA, 29 bp, Artificial Sequence
  source: /note="Description of Artificial Sequence: Synthetic primer"
gtcttacctacaactgtgagtctggtgcc

SEQ ID NO: 6495 - DNA, 28 bp, Artificial Sequence
  source: /note="Description of Artificial Sequence: Synthetic primer"
ccttacctacaacggttaacctggtccc

SEQ ID NO: 6496 - DNA, 31 bp, Artificial Sequence
  source: /note="Description of Artificial Sequence: Synthetic primer"
cttactcacctacaacagtgagccaacttcc

SEQ ID NO: 6497 - DNA, 26 bp, Artificial Sequence
  source: /note="Description of Artificial Sequence: Synthetic primer"
atacccaagacagagagctgggttcc

SEQ ID NO: 6498 - DNA, 29 bp, Artificial Sequence
  source: /note="Description of Artificial Sequence: Synthetic primer"
aacttacctaggatggagagtcgagtccc

SEQ ID NO: 6499 - DNA, 22 bp, Artificial Sequence
  source: /note="Description of Artificial Sequence: Synthetic primer"
ctgtcacagtgagcctggtccc

SEQ ID NO: 6500 - DNA, 18 bp, Artificial Sequence
  source: /note="Description of Artificial Sequence: Synthetic primer"
cacggtgagccgtgtccc

SEQ ID NO: 6501 - DNA, 22 bp, Artificial Sequence
  source: /note="Description of Artificial Sequence: Synthetic primer"
ccagtacggtcagcctagagcc

SEQ ID NO: 6502 - DNA, 18 bp, Artificial Sequence
  source: /note="Description of Artificial Sequence: Synthetic primer"
cactgtcagccgggtgcc

SEQ ID NO: 6503 - DNA, 18 bp, Artificial Sequence
  source: /note="Description of Artificial Sequence: Synthetic primer"
cactgagagccgggtccc

SEQ ID NO: 6504 - DNA, 17 bp, Artificial Sequence
  source: /note="Description of Artificial Sequence: Synthetic primer"
accaggagccgcgtgcc

SEQ ID NO: 6505 - DNA, 18 bp, Artificial Sequence
  source: /note="Description of Artificial Sequence: Synthetic primer"
cacggtcagcctgctgcc

SEQ ID NO: 6506 - DNA, 18 bp, Artificial Sequence
  source: /note="Description of Artificial Sequence: Synthetic primer"
gaccgtgagcctggtgcc

SEQ ID NO: 6507 - DNA, 25 bp, Artificial Sequence
  source: /note="Description of Artificial Sequence: Synthetic primer"
cgctagctggggctcacagtgctca

SEQ ID NO: 6508 - DNA, 27 bp, Artificial Sequence
  source: /note="Description of Artificial Sequence: Synthetic primer"
cactgggctcagagtcctctcccacac

SEQ ID NO: 6509 - DNA, 36 bp, Artificial Sequence
  source: /note="Description of Artificial Sequence: Synthetic primer"
cctatacagcactgggctcagagtcctctctgagac

SEQ ID NO: 6510 - DNA, 24 bp, Artificial Sequence
  source: /note="Description of Artificial Sequence: Synthetic primer"
cctaagccaggggcagacccgagt

SEQ ID NO: 6511 - DNA, 36 bp, Artificial Sequence
  source: /note="Description of Artificial Sequence: Synthetic primer"
acagtgtcacagagtccatcaaaaacccatgcctgg

SEQ ID NO: 6512 - DNA, 33 bp, Artificial Sequence
  source: /note="Description of Artificial Sequence: Synthetic primer"
cactatccacataagcgagggacagacccgagt

SEQ ID NO: 6513 - DNA, 20 bp, Artificial Sequence
  source: /note="Description of Artificial Sequence: Synthetic primer"
tgccctcgatggcaggcgga

SEQ ID NO: 6514 - DNA, 33 bp, Artificial Sequence
  source: /note="Description of Artificial Sequence: Synthetic primer"
cctcttccaggacagtcctcagtggcatcacag

SEQ ID NO: 6515 - DNA, 25 bp, Artificial Sequence
  source: /note="Description of Artificial Sequence: Synthetic primer"
cagacccacctgccctcaatggcag

SEQ ID NO: 6516 - DNA, 35 bp, Artificial Sequence
  source: /note="Description of Artificial Sequence: Synthetic primer"
tctccagggagacactgtgcatgtctggtacctaa

SEQ ID NO: 6517 - DNA, 27 bp, Artificial Sequence
  source: /note="Description of Artificial Sequence: Synthetic primer"
gggacacagtgcatgtctggtccctga

SEQ ID NO: 6518 - DNA, 30 bp, Artificial Sequence
  source: /note="Description of Artificial Sequence: Synthetic primer"
ggacccctattccagacaccagacagaggc

SEQ ID NO: 6519 - DNA, 26 bp, Artificial Sequence
  source: /note="Description of Artificial Sequence: Synthetic primer"
ccccactccagacaccagacagaggg

SEQ ID NO: 6520 - DNA, 28 bp, Artificial Sequence
  source: /note="Description of Artificial Sequence: Synthetic primer"
ggggtctcccacgtgttttggggctaac

SEQ ID NO: 6521 - DNA, 24 bp, Artificial Sequence
  source: /note="Description of Artificial Sequence: Synthetic primer"
gctagctggggctgccagtcctca

SEQ ID NO: 6522 - DNA, 35 bp, Artificial Sequence
  source: /note="Description of Artificial Sequence: Synthetic primer"
tctgcatctgtaggagacagagtcaccatcacttg

SEQ ID NO: 6523 - DNA, 35 bp, Artificial Sequence
  source: /note="Description of Artificial Sequence: Synthetic primer"
tctgcatctacaggagacagagtcaccatcacttg

SEQ ID NO: 6524 - DNA, 35 bp, Artificial Sequence
  source: /note="Description of Artificial Sequence: Synthetic primer"
ctgcatctgtaaggagacagtgtcaccatcacttg

SEQ ID NO: 6525 - DNA, 35 bp, Artificial Sequence
  source: /note="Description of Artificial Sequence: Synthetic primer"
tctgcatctacaggagacagagtcaccatcagttg

SEQ ID NO: 6526 - DNA, 35 bp, Artificial Sequence
  source: /note="Description of Artificial Sequence: Synthetic primer"
actgcatctgtaggagagagagtcaccatcacttg

SEQ ID NO: 6527 - DNA, 33 bp, Artificial Sequence
  source: /note="Description of Artificial Sequence: Synthetic primer"
gcatctgtaaggagacagcgtcaccatcacttg

SEQ ID NO: 6528 - DNA, 36 bp, Artificial Sequence
  source: /note="Description of Artificial Sequence: Synthetic primer"
gtctgcatctgtaggagacagagtcagtatcatttg

SEQ ID NO: 6529 - DNA, 23 bp, Artificial Sequence
  source: /note="Description of Artificial Sequence: Synthetic primer"
ggagagccggcctccatctcctg

SEQ ID NO: 6530 - DNA, 26 bp, Artificial Sequence
  source: /note="Description of Artificial Sequence: Synthetic primer"
cctggagagccagcctccatctcctg

SEQ ID NO: 6531 - DNA, 25 bp, Artificial Sequence
  source: /note="Description of Artificial Sequence: Synthetic primer"
ctggagagccggcctccatctcttg

SEQ ID NO: 6532 - DNA, 31 bp, Artificial Sequence
  source: /note="Description of Artificial Sequence: Synthetic primer"
tcttccttggagagccatcctccatttcctg

SEQ ID NO: 6533 - DNA, 23 bp, Artificial Sequence
  source: /note="Description of Artificial Sequence: Synthetic primer"
ggacagccggcctccatctcctg

SEQ ID NO: 6534 - DNA, 24 bp, Artificial Sequence
  source: /note="Description of Artificial Sequence: Synthetic primer"
tggagagccggcctccatctcctg

SEQ ID NO: 6535 - DNA, 36 bp, Artificial Sequence
  source: /note="Description of Artificial Sequence: Synthetic primer"
ataatatttgtacataactttgtacttcatctcctg

SEQ ID NO: 6536 - DNA, 28 bp, Artificial Sequence
  source: /note="Description of Artificial Sequence: Synthetic primer"
cccctggaaagccagcctctatctcctg

SEQ ID NO: 6537 - DNA, 32 bp, Artificial Sequence
  source: /note="Description of Artificial Sequence: Synthetic primer"
ctcttccttggagagccatcctccatttcctg

SEQ ID NO: 6538 - DNA, 23 bp, Artificial Sequence
  source: /note="Description of Artificial Sequence: Synthetic primer"
ggacagccggcctccatctcctt

SEQ ID NO: 6539 - DNA, 26 bp, Artificial Sequence
  source: /note="Description of Artificial Sequence: Synthetic primer"
cctggagagcaggcctccatgtcctg

SEQ ID NO: 6540 - DNA, 26 bp, Artificial Sequence
  source: /note="Description of Artificial Sequence: Synthetic primer"
ccaggggaaagagccaccctctcctg

SEQ ID NO: 6541 - DNA, 27 bp, Artificial Sequence
  source: /note="Description of Artificial Sequence: Synthetic primer"
tccaggggaaagagtcaccctctcctg

SEQ ID NO: 6542 - DNA, 35 bp, Artificial Sequence
  source: /note="Description of Artificial Sequence: Synthetic primer"
tctttgtctctggagaaaaaagccaccctgacttg

SEQ ID NO: 6543 - DNA, 29 bp, Artificial Sequence
  source: /note="Description of Artificial Sequence: Synthetic primer"
tctctaggggaaaaagccaccctcaccta

SEQ ID NO: 6544 - DNA, 23 bp, Artificial Sequence
  source: /note="Description of Artificial Sequence: Synthetic primer"
ggggaaggagccaccctcacctg

SEQ ID NO: 6545 - DNA, 24 bp, Artificial Sequence
  source: /note="Description of Artificial Sequence: Synthetic primer"
gggcgagagggccaccatcaactg

SEQ ID NO: 6546 - DNA, 32 bp, Artificial Sequence
  source: /note="Description of Artificial Sequence: Synthetic primer"
gcgactccaggagacaaagtcaacatctcctg

SEQ ID NO: 6547 - DNA, 34 bp, Artificial Sequence
  source: /note="Description of Artificial Sequence: Synthetic primer"
ctgtgactccaaaggagaaagtcaccatcacctg

SEQ ID NO: 6548 - DNA, 29 bp, Artificial Sequence
  source: /note="Description of Artificial Sequence: Synthetic primer"
actccaggggagaaagtcaccatcacctg

SEQ ID NO: 6549 - DNA, 25 bp, Artificial Sequence
  source: /note="Description of Artificial Sequence: Synthetic primer"
caggacagagggccaccatcacctg

SEQ ID NO: 6550 - DNA, 24 bp, Artificial Sequence
  source: /note="Description of Artificial Sequence: Synthetic primer"
gcaggacactcactcccccacctg

SEQ ID NO: 6551 - DNA, 25 bp, Artificial Sequence
  source: /note="Description of Artificial Sequence: Synthetic primer"
tgggccagagggtcaccatctcctg

SEQ ID NO: 6552 - DNA, 23 bp, Artificial Sequence
  source: /note="Description of Artificial Sequence: Synthetic primer"
gggcaggtgggtaccagctcctg

SEQ ID NO: 6553 - DNA, 27 bp, Artificial Sequence
  source: /note="Description of Artificial Sequence: Synthetic primer"
cgtgggacagaaggtcaccctctcctg

SEQ ID NO: 6554 - DNA, 29 bp, Artificial Sequence
  source: /note="Description of Artificial Sequence: Synthetic primer"
tctctgggagcatcttccagactcacctg

SEQ ID NO: 6555 - DNA, 27 bp, Artificial Sequence
  source: /note="Description of Artificial Sequence: Synthetic primer"
cacctccggatcagccagactctcctg

SEQ ID NO: 6556 - DNA, 26 bp, Artificial Sequence
  source: /note="Description of Artificial Sequence: Synthetic primer"
ccgggagcatgagccagacttacctg

SEQ ID NO: 6557 - DNA, 36 bp, Artificial Sequence
  source: /note="Description of Artificial Sequence: Synthetic primer"
ctctgcacatctgagaaatgctataagacttccctg

SEQ ID NO: 6558 - DNA, 27 bp, Artificial Sequence
  source: /note="Description of Artificial Sequence: Synthetic primer"
tgtgggagcctcggtcaagcttacctc

SEQ ID NO: 6559 - DNA, 26 bp, Artificial Sequence
  source: /note="Description of Artificial Sequence: Synthetic primer"
cccaggcagagggtcaccatctcctg

SEQ ID NO: 6560 - DNA, 26 bp, Artificial Sequence
  source: /note="Description of Artificial Sequence: Synthetic primer"
ccagggcagagggtcaccatctcctg

SEQ ID NO: 6561 - DNA, 25 bp, Artificial Sequence
  source: /note="Description of Artificial Sequence: Synthetic primer"
ccgggcagagggtcaccatctcttg

SEQ ID NO: 6562 - DNA, 28 bp, Artificial Sequence
  source: /note="Description of Artificial Sequence: Synthetic primer"
ccccaggacagaaggtcaccatctcctg

SEQ ID NO: 6563 - DNA, 28 bp, Artificial Sequence
  source: /note="Description of Artificial Sequence: Synthetic primer"
ccacaaggcagaggctcactgtctcctg

SEQ ID NO: 6564 - DNA, 30 bp, Artificial Sequence
  source: /note="Description of Artificial Sequence: Synthetic primer"
gtctcctggacagtcagtcaccatctcctg

SEQ ID NO: 6565 - DNA, 30 bp, Artificial Sequence
  source: /note="Description of Artificial Sequence: Synthetic primer"
gtctcctggacagtcgatcaccatctcctg

SEQ ID NO: 6566 - DNA, 27 bp, Artificial Sequence
  source: /note="Description of Artificial Sequence: Synthetic primer"
tcctggacagtcggtcaccatctcctg

SEQ ID NO: 6567 - DNA, 33 bp, Artificial Sequence
  source: /note="Description of Artificial Sequence: Synthetic primer"
ctgggacttggggtaaacagtcaccatcttctg

SEQ ID NO: 6568 - DNA, 26 bp, Artificial Sequence
  source: /note="Description of Artificial Sequence: Synthetic primer"
ccaggacagacagccagcatcacctg

SEQ ID NO: 6569 - DNA, 28 bp, Artificial Sequence
  source: /note="Description of Artificial Sequence: Synthetic primer"
ctttgggacgtacggccaggatcatctg

SEQ ID NO: 6570 - DNA, 28 bp, Artificial Sequence
  source: /note="Description of Artificial Sequence: Synthetic primer"
ctttgggacagatggccaggatcacctg

SEQ ID NO: 6571 - DNA, 26 bp, Artificial Sequence
  source: /note="Description of Artificial Sequence: Synthetic primer"
ccaggacaggcagccatgatcacctg

SEQ ID NO: 6572 - DNA, 25 bp, Artificial Sequence
  source: /note="Description of Artificial Sequence: Synthetic primer"
tgggacagagggccaggatcaccta

SEQ ID NO: 6573 - DNA, 24 bp, Artificial Sequence
  source: /note="Description of Artificial Sequence: Synthetic primer"
gggacaggcggccaggattacctg

SEQ ID NO: 6574 - DNA, 26 bp, Artificial Sequence
  source: /note="Description of Artificial Sequence: Synthetic primer"
ccaggacaaacggccaggatcacctg

SEQ ID NO: 6575 - DNA, 27 bp, Artificial Sequence
  source: /note="Description of Artificial Sequence: Synthetic primer"
cacagcacagatggccaggatcacctg

SEQ ID NO: 6576 - DNA, 26 bp, Artificial Sequence
  source: /note="Description of Artificial Sequence: Synthetic primer"
ccaggacagacagccaggatcagctg

SEQ ID NO: 6577 - DNA, 28 bp, Artificial Sequence
  source: /note="Description of Artificial Sequence: Synthetic primer"
ccccaggacagatgaccaggatcacctg

SEQ ID NO: 6578 - DNA, 28 bp, Artificial Sequence
  source: /note="Description of Artificial Sequence: Synthetic primer"
ccctaggacagatggccaggatcacctg

SEQ ID NO: 6579 - DNA, 31 bp, Artificial Sequence
  source: /note="Description of Artificial Sequence: Synthetic primer"
gtgtctgtggacagtcagcaagggtaacctg

SEQ ID NO: 6580 - DNA, 30 bp, Artificial Sequence
  source: /note="Description of Artificial Sequence: Synthetic primer"
ggccttgggacagacagtcaggatcacatg

SEQ ID NO: 6581 - DNA, 28 bp, Artificial Sequence
  source: /note="Description of Artificial Sequence: Synthetic primer"
ccccaggaaagacggccaggattacctg

SEQ ID NO: 6582 - DNA, 27 bp, Artificial Sequence
  source: /note="Description of Artificial Sequence: Synthetic primer"
cccaggacagaaagccaggatcacctg

SEQ ID NO: 6583 - DNA, 34 bp, Artificial Sequence
  source: /note="Description of Artificial Sequence: Synthetic primer"
cagtagctccaggacagatgactaggatcacctg

SEQ ID NO: 6584 - DNA, 25 bp, Artificial Sequence
  source: /note="Description of Artificial Sequence: Synthetic primer"
caggacagacggccaggatcacctg

SEQ ID NO: 6585 - DNA, 27 bp, Artificial Sequence
  source: /note="Description of Artificial Sequence: Synthetic primer"
cctgggacagtcagccagggtaacctg

SEQ ID NO: 6586 - DNA, 25 bp, Artificial Sequence
  source: /note="Description of Artificial Sequence: Synthetic primer"
cgggacagacagccaggatcacctg

SEQ ID NO: 6587 - DNA, 27 bp, Artificial Sequence
  source: /note="Description of Artificial Sequence: Synthetic primer"
cccaggacagacacccaggatcacctg

SEQ ID NO: 6588 - DNA, 28 bp, Artificial Sequence
  source: /note="Description of Artificial Sequence: Synthetic primer"
ccccattacagatggccaggatcacctg

SEQ ID NO: 6589 - DNA, 29 bp, Artificial Sequence
  source: /note="Description of Artificial Sequence: Synthetic primer"
gccttgggatagacagccaggatcacctg

SEQ ID NO: 6590 - DNA, 28 bp, Artificial Sequence
  source: /note="Description of Artificial Sequence: Synthetic primer"
ccttgggacaaatggccaggatcacctg

SEQ ID NO: 6591 - DNA, 26 bp, Artificial Sequence
  source: /note="Description of Artificial Sequence: Synthetic primer"
ctgggagcctcgatcaagctcacctg

SEQ ID NO: 6592 - DNA, 27 bp, Artificial Sequence
  source: /note="Description of Artificial Sequence: Synthetic primer"
cctgggatcctcggtcaagctcacctg

SEQ ID NO: 6593 - DNA, 24 bp, Artificial Sequence
  source: /note="Description of Artificial Sequence: Synthetic primer"
gggagcctcggtcaagctcacctg

SEQ ID NO: 6594 - DNA, 27 bp, Artificial Sequence
  source: /note="Description of Artificial Sequence: Synthetic primer"
tcctggagaatccgccagactcacctg

SEQ ID NO: 6595 - DNA, 29 bp, Artificial Sequence
  source: /note="Description of Artificial Sequence: Synthetic primer"
tctcctggagcatcagccagattcacctg

SEQ ID NO: 6596 - DNA, 27 bp, Artificial Sequence
  source: /note="Description of Artificial Sequence: Synthetic primer"
tcctggagcatcagccagtctcacctg

SEQ ID NO: 6597 - DNA, 27 bp, Artificial Sequence
  source: /note="Description of Artificial Sequence: Synthetic primer"
tcctggagcatcagccagactcacctg

SEQ ID NO: 6598 - DNA, 32 bp, Artificial Sequence
  source: /note="Description of Artificial Sequence: Synthetic primer"
gcatcttctggagcatcagtcagactcacctg

SEQ ID NO: 6599 - DNA, 27 bp, Artificial Sequence
  source: /note="Description of Artificial Sequence: Synthetic primer"
tccggggaagacggtaaccatctcctg

SEQ ID NO: 6600 - DNA, 27 bp, Artificial Sequence
  source: /note="Description of Artificial Sequence: Synthetic primer"
cccaggagggacagtcactctcaccta

SEQ ID NO: 6601 - DNA, 27 bp, Artificial Sequence
  source: /note="Description of Artificial Sequence: Synthetic primer"
cccaggagggacagtcactctcacctg

SEQ ID NO: 6602 - DNA, 28 bp, Artificial Sequence
  source: /note="Description of Artificial Sequence: Synthetic primer"
cccctggagggacagtcacactcacttg

SEQ ID NO: 6603 - DNA, 25 bp, Artificial Sequence
  source: /note="Description of Artificial Sequence: Synthetic primer"
tgggagcctcggtcacactcacctg

SEQ ID NO: 6604 - DNA, 27 bp, Artificial Sequence
  source: /note="Description of Artificial Sequence: Synthetic primer"
cttgagacagaccgccacactcacctg

SEQ ID NO: 6605 - DNA, 32 bp, Artificial Sequence
  source: /note="Description of Artificial Sequence: Synthetic primer"
ttctactcacgtttgatttccaccttggtccc

SEQ ID NO: 6606 - DNA, 32 bp, Artificial Sequence
  source: /note="Description of Artificial Sequence: Synthetic primer"
aagtacttacgtttgatctccagcttggtccc

SEQ ID NO: 6607 - DNA, 36 bp, Artificial Sequence
  source: /note="Description of Artificial Sequence: Synthetic primer"
acagatgtacttacgtttgatatccactttggtccc

SEQ ID NO: 6608 - DNA, 29 bp, Artificial Sequence
  source: /note="Description of Artificial Sequence: Synthetic primer"
cacttacgtttgatctccaccttggtccc

SEQ ID NO: 6609 - DNA, 36 bp, Artificial Sequence
  source: /note="Description of Artificial Sequence: Synthetic primer"
gaaaaattacttacgtttaatctccagtcgtgtccc

SEQ ID NO: 6610 - DNA, 27 bp, Artificial Sequence
  source: /note="Description of Artificial Sequence: Synthetic primer"
cttacctaggacggtgaccttggtccc

SEQ ID NO: 6611 - DNA, 24 bp, Artificial Sequence
  source: /note="Description of Artificial Sequence: Synthetic primer"
acctaggacggtcagcttggtccc

SEQ ID NO: 6612 - DNA, 36 bp, Artificial Sequence
  source: /note="Description of Artificial Sequence: Synthetic primer"
aagaagagactcatctaaaatgatcagctgggttcc

SEQ ID NO: 6613 - DNA, 24 bp, Artificial Sequence
  source: /note="Description of Artificial Sequence: Synthetic primer"
atctaggacggtcagctccgtccc

SEQ ID NO: 6614 - DNA, 21 bp, Artificial Sequence
  source: /note="Description of Artificial Sequence: Synthetic primer"
gaggacggtcaccttggtgcc

SEQ ID NO: 6615 - DNA, 20 bp, Artificial Sequence
  source: /note="Description of Artificial Sequence: Synthetic primer"
aggacggtcagctgggtgcc

SEQ ID NO: 6616 - DNA, 24 bp, Artificial Sequence
  source: /note="Description of Artificial Sequence: Synthetic primer"
ctgcagactcatgaggagtcgccc
